(12) United States Patent
Eckert et al.

(10) Patent No.: US 8,389,679 B2
(45) Date of Patent: Mar. 5, 2013

(54) TARGETED ANTIMICROBIAL MOIETIES

(75) Inventors: Randal H. Eckert, Redondo Beach, CA (US); Daniel Yarbrough, Los Angeles, CA (US); Wenyuan Shi, Los Angeles, CA (US); Maxwell Anderson, Sequim, WA (US); Jian He, Los Angeles, CA (US); Chris Kaplan, Los Angeles, CA (US); Jee-Hyun Sim, Garden Grove, CA (US)

(73) Assignee: The Regents of the University of California, Oakland, CA (US)

( * ) Notice: Subject to any disclaimer, the term of this patent is extended or adjusted under 35 U.S.C. 154(b) by 167 days.

(21) Appl. No.: 12/701,443

(22) Filed: Feb. 5, 2010

(65) Prior Publication Data

US 2010/0316643 A1 Dec. 16, 2010

Related U.S. Application Data

(60) Provisional application No. 61/224,825, filed on Jul. 10, 2009, provisional application No. 61/150,287, filed on Feb. 5, 2009.

(51) Int. Cl.
*A61K 39/395* (2006.01)
(52) U.S. Cl. ....... 530/324; 424/134.1; 435/34; 514/21.3
(58) Field of Classification Search .................. None
See application file for complete search history.

(56) References Cited

U.S. PATENT DOCUMENTS

| | | | |
|---|---|---|---|
| 7,569,542 B2 * | 8/2009 | Eckert et al. | 514/1.1 |
| 7,846,895 B2 * | 12/2010 | Eckert et al. | 514/2.6 |
| 2007/0111251 A1 * | 5/2007 | Rosania et al. | 435/7.1 |
| 2008/0170991 A1 * | 7/2008 | Shi et al. | 424/1.69 |
| 2011/0039761 A1 * | 2/2011 | Eckert et al. | 514/2.4 |
| 2011/0262508 A1 * | 10/2011 | Watt et al. | 424/405 |
| 2012/0003661 A1 * | 1/2012 | Eckert et al. | 435/6.15 |

FOREIGN PATENT DOCUMENTS

WO 2008/030988 * 3/2008

OTHER PUBLICATIONS

Adjic et al., "Genome sequence of *Streptococcus mutans* UA159, a cariogenic dental pathogen". Proc Natl Acad Sci USA, vol. 99, No. 22, Oct. 29, 2002, pp. 14434-14439.
Brogden, "Antimicrobial peptides: pore formers or metabolic inhibitors in 10 bacteria?". Nature Reviews Microbiology, vol. 3, Mar. 2005, pp. 238-250.
Charles et al., "In vivo antimicrobial activity of an essential oil-containing mouthrinse on interproximal plaque bacteria". Journal of Clinical Dentistry, vol. 11, 2000, pp. 94-97.
Chen et al., "Inhibition 15 of growth of *Streptococcus mutans*, methicillin-resistant *Staphylococcus aureus*, and vancomycin-resistant enterococci by kurarinone, a bioactive flavonoid isolated from *Sophora flavescens*". Journal of Clinical Microbiology, vol. 43, 2005, pp. 3574-3575.
Eckert et al., "Targeted killing of *Streptococcus mutans* by a pheromone-guided "smart" antimicrobial peptide". Antimicrobial Agents and Chemotherapy, vol. 50, No. 11, Oct. 23, 2006, pp. 3651-3657.
Eckert et al., "Adding selectivity to antimicrobial peptides: rational design of a multidomain peptide against *Pseudomonas* spp ". Antimicrobial Agents and Chemotherapy, vol. 50, No. 4, 2006, pp. 1480-1488.

(Continued)

*Primary Examiner* — Albert Navarro
*Assistant Examiner* — Ginny Portner
(74) *Attorney, Agent, or Firm* — Gates & Cooper LLP

(57) ABSTRACT

This invention provides novel targeted antimicrobial compositions. In various embodiments chimeric moieties are provided comprising an antimicrobial peptide attached to a peptide targeting moiety that binds a bacterial strain or species.

37 Claims, 19 Drawing Sheets

OTHER PUBLICATIONS

Eckert et al., "Enhancement of antimicrobial activity against 20 *Pseudomonas aeruginosa* by coadministration of G10KHc and tobramycin". Antimicrobial Agents and Chemotherapy, vol. 50, No. 11, Aug. 28, 2006, pp. 3833-3838.

Fauchere et al., "Hydrophobic parameters-pi of amino-acid side chains from the partitioning of N-acetyl-amino-acid amides". European Journal of Medicinal Chemistry, vol. 18, No. 4, 1983. pp. 369-375.

He et al., "Novel synthetic antimicrobial peptides against *Streptococcus mutans*". Antimicrobial Agents and Chemotherapy, vol. 51, No. 4, Feb. 12, 2007, pp. 1351-1358.

He et al., "Design and activity of a 'dual-targeted' antimicrobial peptide". Int J Antimicrob Agents, vol. 33, No. 6, Jun. 2009, pp. 532-537.

Isturiz, "Global resistance trends and the potential impact on empirical therapy". International Journal of Antimicrobial Agents, vol. 32, No. S4, 2008, pp. S201-S206.

Lopez et al., "Global and regional burden of disease and risk factors, 200 1 : systematic analysis of population health data". The Lancet, vol. 367, May 27, 2006, pp. 1747-1757.

Mokdad et al., "Actual causes of death in the United States". JAMA, vol. 291, No. 10, Mar. 10, 2004, pp. 1238-1245.

Patrzykat et al., "Sublethal concentrations of pleurocidin-derived antimicrobial peptides inhibit macromolecular synthesis in *Escherichia coli*". Antimicrobial Agents and Chemotherapy, vol. 46, No. 3, 2002, pp. 605-614.

Qi et al., "Peptide pheromone induced cell death of *Streptococcus mutans*". FEMS Microbiology Letters, vol. 251, 2005, pp. 321-326.

Ruby et al., "Nature of symbiosis in oral disease". Journal of Dental Research, vol. 86, 2007, pp. 8-11.

Strom et al., "Cloning and expression of the Pilin gene of *Pseudomonas aeruginosa* PAK in *Escherichia coli*". Journal of Bacteriology, vol. 165, No. 2, Feb. 1986, pp. 367-372.

ten Cate, "Biofilms, a new approach to the microbiology of dental plaque". Odontology, vol. 94, 2006, pp. 1-9.

Tincu et al., "Plicatamide, an antimicrobial octapeptide from *Styela plicata* hemocytes". The Journal of Biological Chemistry, vol. 278, No. 15, Apr. 11, 2003, pp. 13546-13553.

Zinder et al., "Genetic exchange in *Salmonella*". Journal of Bacteriology, vol. 64, Apr. 18, 1952, pp. 679-699.

Muhle et al., "Design of Gram-Negative Selective Antimicrobial Peptides". Biochemistry, vol. 40, 2001, pp. 5777-5785.

International Preliminary Report on Patentability mailed Aug. 9, 2011 and Written Opinion of the International Search Authority mailed Dec. 27, 2010 for International Application No. PCT/US2010/023376, pp. 1-5.

\* cited by examiner

Formula I

(91) $R = -\underset{\underset{OH}{|}}{CH}-CH_3$

(92) $R = V$

(93) $R = Et$

(94) $R = -H$

(95) $R = -COCH_3$

(96) $R = -CHO$

(97) $R = -\underset{\underset{OH}{|}}{CH}-CH_2OH$

(98) $R = -CH=CHCO_2H$

(99) $R = P^R$ $P^R = CH_2CH_2CO_2R$,
R = H, alkyl, alkoxyl, alkenyl or alkynyl,
all from $C_1$ to $C_8$, but preferably H
Me = methyl

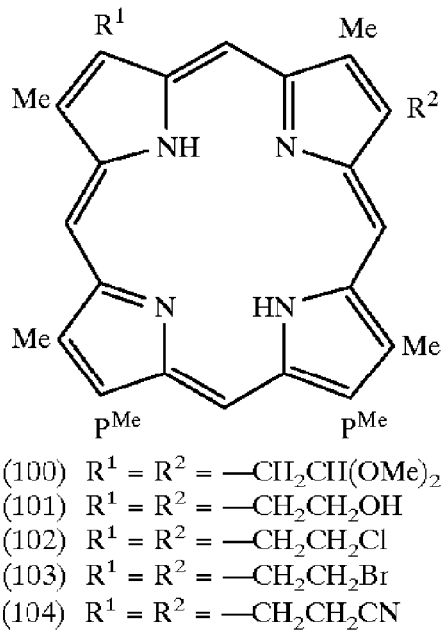

Formula II (100) $R^1 = R^2 = $ —CH$_2$CH(OMe)$_2$
(101) $R^1 = R^2 = $ —CH$_2$CH$_2$OH
(102) $R^1 = R^2 = $ —CH$_2$CH$_2$Cl
(103) $R^1 = R^2 = $ —CH$_2$CH$_2$Br
(104) $R^1 = R^2 = $ —CH$_2$CH$_2$CN (105) $R^1 = $ —CH(OH)—CH$_2$OH; $R^2 = $ V
(106) $R^1 = $ V; $R^2 = $ —CH(OH)—CH$_2$OH
(107) $R^1 = $ —CHO; $R^2 = $ V
(108) $R^1 = $ V; $R^2 = $ —CHO
(109) $R^1 = $ V; $R^2 = $ —CH$_2$CH(OMe)$_2$
(110) $R^1 = $ —CH$_2$CH(OMe)$_2$; $R^2 = $ V
(111) $R^1 = $ V; $R^2 = $ —CH$_2$CH$_2$OH
(112) $R^1 = $ —CH$_2$CH$_2$OH; $R^2 = $ V
(113) $R^1 = $ V; $R^2 = $ P$^{Me}$
(114) $R^1 = $ P$^{Me}$; $R^2 = $ V
(115) $R^1 = $ —H; $R^2 = $ —CH$_2$CH$_2$OH
(116) $R^1 = $ —CH$_2$CH$_2$OH; $R^2 = $ —H
(117) $R^1 = $ —H; $R^2 = $ V
(118) $R^1 = $ V; $R^2 = $ H—

V = vinyl
E+ = ethyl
P$^R$ = CH$_2$CH$_2$CO$_2$R,
R = H, alkyl, alkoxyl, alkenyl or alkynyl, all from C$_1$ to C$_8$, but preferably H.
Me = methyl

FIG. 2

| Compound | M | Substitutions at positions X | Y |
|---|---|---|---|
| 119 | 2H | | SO$_3$H |
| 120 | 2H | | N(CH$_3$)$_3$$^+$ |
| 121 | HOSiOSiCH$_2$CH$_2$N(CH$_3$)$_2$ | H | |
| 121, 122, 123 | GaIII/ AlIII/ ZnII | | SO$_3$H / C(CH$_3$)$_3$ |
| 124 | 2H | | C(CH$_3$)$_3$ |
| 125 | Zn | | CH$_2$-N$^+$⟨pyridine⟩ |
| 126 | Zn | | SO$_2$N(CH$_2$CH$_2$OH)$_2$ |
| 126 | Zn | | SO$_3$H |

Monastral Fast Blue B
(phthalocyanine)

Monastral Fast Blue G
(CI Pigment Blue 15)

|              | R          | R''       | R'       | X      | Y  |
|--------------|------------|-----------|----------|--------|----|
| Methylene blue | (CH₃)₂N  | N(CH₃)₂   | H        | N      | S  |
| Toluidine blue O | (CH₃)₂N | NH₂      | CH₃      | N      | S  |
| Neutral red  | (CH₃)₂N    | NH₂       | CH₃      | N      | NH |
| Proflavine   | H₂N        | NH₂       | H        | CH     | NH |
| Acridine orange | (CH₃)₂N | N(CH₃)₂   | H        | CH     | NH |
| Aminacrine   | H          | H         | H        | C-NH₂  | NH |
| Ethacridine  | H₂N        | H         | OC₂H₅    | C-NH₂  | NH |

| X | R | X | R |
|---|---|---|---|
| Merocyanines | – | Dicarbocyanines | – |
| O (MC540) | – | S | Et |
| S | – | Se | H |
| Se | – | O (DHOCI) | H |

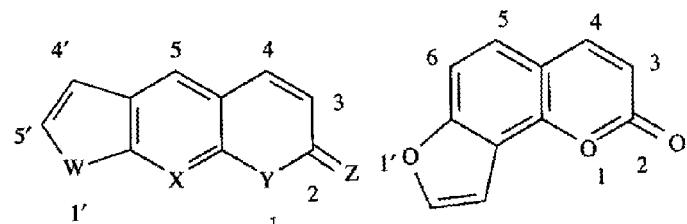
| W | X | Y | Z | |
|---|---|---|---|---|
| O | CH | O | O | psoralen |
| S | CH | O | O | thienocoumarin |
| O | N | O | O | 8-azacoumarin |
| O | CH | O | S | 2-thiofuranocoumarin |
| O | CH | O | Se | 2-selenofuranocoumarin |
FIG. 7
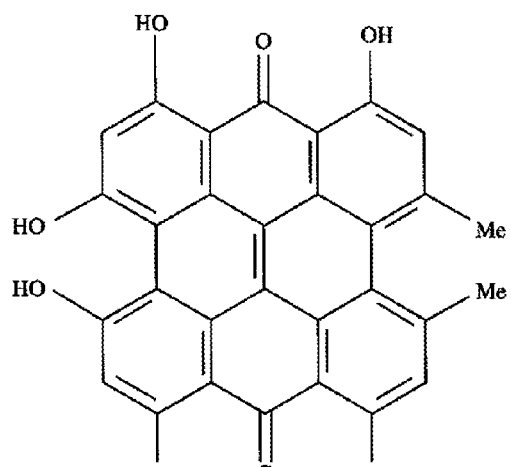
Hypericin
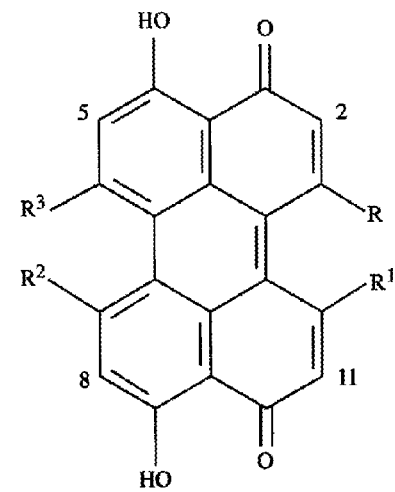
Perylenequinonoids
| R | $R^1$ | $R^2$ | $R^3$ | |
|---|---|---|---|---|
| R/$R^1$ | -CH$_2$C(OH)MeCH(COMe)- | OMe | OMe | hypocrellin A |
| R/$R^1$ | -CH$_2$CMe=C(COMe)- | OMe | OMe | hypocrellin B |
| -CH$_2$CHMeCOPh | -CH$_2$CHMeOCO-$p$-C$_6$H$_4$OH | OMe | OMe | calphostin C |
FIG. 8

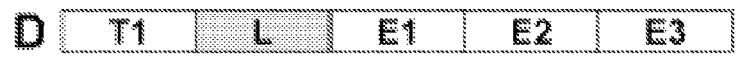
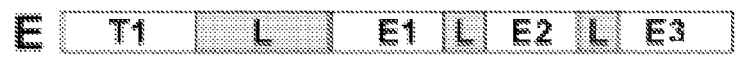
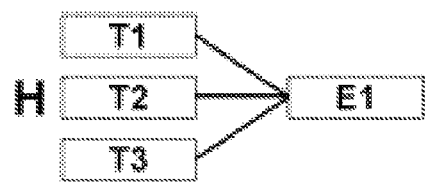
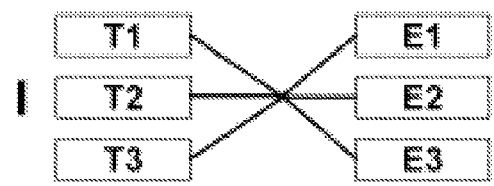
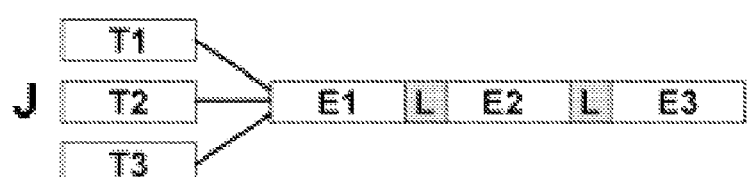
FIG. 12

TFFRFLNRGGG-K〜〜〜-FIRKFLKKWLL
            |
KKHRKHRKHRKHGGG

MH(KH)-20
          (mw 4884.91)

DAANEAGGG-K〜〜〜-FIRKFLKKWLL
           |
KKHRKHRKHRKHGGG

BL(KH)-20
          (mw 4373.4)

TFFRFLNRGGG-K〜〜〜-FIRKFLKKWLL
            |
    DAANEAGGG

Minimal inhibitory concentration (MIC) of Library 1 STAMPs

| Peptide | Sequence[b] | S. mutans | E. coli | S. sobrinus | S. sanguinis | S. aureus | P. aeruginosa | E. faecium |
|---|---|---|---|---|---|---|---|---|
| 135(L7)2_1 | FHFHLHFPYPFIKHFIHRF | 32 | 125 | 48 | 64 | >250 | 125 | 250 |
| 135(L3)2_1 | FHFHLHFSATFIKHFIHRF | 16 | 125 | 250 | 64 | 125 | 125 | 64 |
| 135(L1)2_1 | FHFHLHFGGGFIKHFIHRF | 24 | 64 | 64 | 64 | 125 | 64 | 64 |
| 135(L8)2_1 | FHFHLHFPSGSPFIKHFIHRF | 64 | 125 | 64 | 64 | >250 | >250 | 250 |
| 135(L9)2_1 | FHFHLHFPSPSPFIKHFIHRF | 32 | 64 | 125 | 125 | >250 | 125 | 250 |
| 135(L5)2_1 | FHFHLHFASASAFIKHFIHRF | 16 | 64 | 32 | 32 | 64 | 125 | 48 |
| 3_1(L1)135 | LIKHILHRLGGGFHFHLHF | 16 | >250 | 32 | 48 | 64 | >250 | 32 |
| PL-135 | FHFHLHF | 8 | 8 | nt | 12 | 32 | 12 | 12 |

[a] MICs (μg/mL) represent averages of at least 3 independent experiments
[b] all C-termini amidated
nt – not tested

Fig. 17

Minimal inhibitory concentration (MIC) of 2_1-containing STAMPs (Library 3)

| Name | Sequence[b] | S. mu | S. gor. | S. san | S. mit. | MRSA | PA | SEQ ID: |
|---|---|---|---|---|---|---|---|---|
| 2C-4* | RWRWRWF | 4-8 | 32 | 32 | 32 | 32 | 32 | 1860 |
| 2_1(L1)2C-4 | FIKHFIHRFGGGRWRWRWF | 8 | 32 | 32 | 32 | 32 | 64 | 1977 |
| 2_1(L6)2C-4 | FIKHFIHRFSGGRWRWRWF | 8 | 32 | 32 | 32 | 32 | 64 | 1978 |
| 2_1(L3)2C-4 | FIKHFIHRFSATRWRWRWF | 8 | 32 | 32 | 16 | 125 | 64 | 1979 |
| 2_1(LC)2C-4 | FIKHFIHRF-[NH(CH$_2$)$_7$CO]-RWRWRWF | 12 | 32 | 32 | 16 | 32 | 64 | 1980 |
| 2C-4(L1)2_1 | RWRWRWFGGGFIKHFIHRF | 12 | 32 | 32 | 32 | 32 | 64 | 1982 |
| 2C-4(L6)2_1 | RWRWRWFSGGFIKHFIHRF | 12 | 32 | 32 | 32 | 32 | 64 | 1983 |
| 2C-4(L3)2_1 | RWRWRWFSATFIKHFIHRF | 12 | 62.5 | 32 | 16 | 64 | 64 | 1984 |
| 2C-4(LC)2_1 | RWRWRWF-[NH(CH$_2$)$_7$CO]-FIKHFIHRF | 32 | 62.5 | 32 | 32 | 64 | 96 | 1985 |
| α-11* | RWRRLLKKLHHLLH | 8 | 16 | 16 | 32 | 16 | 8 | 1877 |
| 2_1(LC)α | FIKHFIHRF-[NH(CH$_2$)$_7$CO]-RWRRLLKKLHHLLH | 16 | 32 | 32 | 32 | 64 | 64 | 1987 |
| 2_1(L3)α | FIKHFIHRFSATRWRRLLKKLHHLLH | 16 | 32 | 32 | 32 | 16 | 32 | 1989 |
| 2_1(L6)α | FIKHFIHRFSGGRWRRLLKKLHHLLH | 16 | 24 | 24 | 64 | 24 | 32 | 1990 |
| α(LC)2_1 | RWRRLLKKLHHLLH-[NH(CH$_2$)$_7$CO]-FIKHFIHRF | 12 | 16 | 16 | 32 | 64 | 32 | 1991 |
| α(L3)2_1 | RWRRLLKKLHHLLHSATFIKHFIHRF | 12 | 16 | 16 | 16 | 32 | 32 | 1993 |
| α(L6)2_1 | RWRRLLKKLHHLLHSGGFIKHFIHRF | 12 | 16 | 24 | 32 | 32 | 32 | 1994 |
| α-7* | LQLLKQLLKLLKQF | 8 | 12 | 12 | 24 | 16 | 8 | 1873 |
| 2_1(LC)α | FIKHFIHRF-[NH(CH$_2$)$_7$CO]-LQLLKQLLKLLKQF | 16 | 32 | 32 | 64 | 64 | 64 | 1995 |
| 2_1(L3)α | FIKHFIHRFSATLQLLKQLLKLLKQF | 16 | 12 | 24 | 32 | 64 | 32 | 1997 |
| 2_1(L6)α | FIKHFIHRFSGGLQLLKQLLKLLKQF | 16 | 12 | 32 | 64 | 32 | 32 | 1998 |
| α(LC)2_1 | LQLLKQLLKLLKQF-[NH(CH$_2$)$_7$CO]-FIKHFIHRF | 12 | 16 | 32 | 32 | 64 | 32 | 1999 |
| α(L3)2_1 | LQLLKQLLKLLKQFSATFIKHFIHRF | 12 | 16 | 16 | 24 | 32 | 32 | 2001 |
| α(L6)2_1 | LQLLKQLLKLLKQFSGGFIKHFIHRF | 12 | 24 | 24 | 24 | 32 | 32 | 2002 |
| B-38* | IKQLLHFFQRF | 24 | 32 | 64 | 64 | 64 | 64 | 1826 |
| B38(L1)2_1 | IKQLLHFFQRFGGGFIKHFIHRF | 12 | 32 | 24 | 24 | 64 | 125 | 2003 |
| 2_1(L1)B38 | FIKHFIHRFGGGIKQLLHFFQRF | 12 | 32 | 24 | 16 | 64 | 125 | 2004 |
| B-33* | FKKFWKWFRRF | 8-24 | | | | | | 1821 |
| 2_1(L1)B33 | FIKHFIHRFGGGFKKFWKWFRRF | 4-8 | 62.5 | 16 | 32 | 16 | 64 | 2005 |
| B33(L1)2_1 | FKKFWKWFRRFGGGFIKHFIHRF | 12 | 125 | 32 | 64 | 32 | 125 | 2006 |

[a] Strains: S. mu, *S. mutans* (UA159); S. gor, *S. gordonii* Challis (DL1); S. san, *S.sanguinis* NY101; S. mit, *S. mitis*
[b] All C-termini amidated
*re-plotted from He et al. (Antimicrob Agents Chemother 51:1351-8) for reference

Fig. 18

TARGETED ANTIMICROBIAL MOIETIES

CROSS-REFERENCE TO RELATED APPLICATIONS

This application claims priority to U.S. Provisional Application No. 61/150,287, filed Feb. 5, 2009; and to U.S. Provisional Application No. 61/224,825, filed Jul. 10, 2009, the disclosures of which are incorporated herein by reference in their entirety for all purposes.

STATEMENT OF GOVERNMENTAL SUPPORT

[Not Applicable]

FIELD OF THE INVENTION

The present invention relates to novel targeting peptides, novel antimicrobial peptides, chimeric moieties comprising novel targeting and/or novel antimicrobial peptides and uses thereof.

BACKGROUND OF THE INVENTION

Antibiotic research at the industrial level was originally focused on the identification of refined variants of already existing drugs. This resulted example, in the development of antibiotics such as newer penicillins, cephalosporins, macrolides, and fluoroquinolones.

However, resistance to old and newer antibiotics among bacterial pathogens is evolving rapidly, as exemplified by extended beta-lactamase (ESBL) and quinolone resistant gram-negatives, multi-resistant gonococci, methicillin resistant *Staphylococcus aureus* (MRSA), vancomycin resistant enterococci (VRE), penicillin non-susceptible pneumococci (PNSP) and macrolide resistant pneumococci and streptococci (see, e.g., Panlilo et al. (1992) *Infect. Control Hosp. EpidemioL.*, 13: 582-586; Morris et al. (1995) *Ann Intern Med.*, 123: 250-259, and the like). An overuse, or improper use, of antibiotics is believed to be of great importance for triggering and spread of drug resistant bacteria. Microbes have, in many cases, adapted and are resistant to antibiotics due to constant exposure and improper use of the drugs.

Drug resistant pathogens represent a major economic burden for health-care systems. For example, postoperative and other nosocomial infections will prolong the need for hospital care and increase antibiotic drug expenses. It is estimated that the annual cost of treating drug resistant infections in the United States is approximately $5 billion.

SUMMARY OF THE INVENTION

In certain embodiments, novel targeting moieties (e.g., peptides) that specifically/preferentially bind to microorganisms (e.g., certain bacteria, yeasts, fungi, molds, viruses, algae, protozoa, and the like) are provided. The targeting moieties can be attached to effectors (e.g., detectable labels, drugs, antimicrobial peptides, etc.) to form chimeric constructs for specifically/preferentially delivering the effector to and/or into the target organism. In certain embodiments novel antimicrobial peptides that can be used to inhibit (e.g., kill and/or inhibit growth and/or proliferation) of certain microorganisms (e.g., certain bacteria, yeasts, fungi, molds, viruses, algae, protozoa, and the like) are provided. Any targeting moiety disclosed herein can be attached to any one or more effector disclosed herein. Any targeting moiety disclosed herein can be attached to any one or more antimicrobial peptide disclosed herein.

In certain embodiments chimeric moieties are provided where the chimeric moieties comprise an effector attached to a peptide targeting moiety comprising or consisting of the amino acid sequence of a peptide found in Table 2 and/or Table 15. In certain embodiments the targeting peptide comprises or consists of amino acid or retro or inverso or retro-inverso sequence or beta sequence of a peptide found in Table 2 and/or Table 15. In certain embodiments the effector comprises a moiety selected from the group consisting of a detectable label, an antimicrobial peptide, an antibiotic, and a photosensitizer. In certain embodiments the effector comprises an antimicrobial peptide comprising the amino acid sequence of a peptide found in Table 2, and/or Table 8, and/or Table 9, and/or Table 10. In certain embodiments the effector comprises an antibiotic found in Table 7. In certain embodiments the effector comprises a photosensitizer. In certain embodiments the photosensitizer is selected from the group consisting of a porphyrinic macrocycle, a porphyrin, a chlorine, a crown ether, an acridine, an azine, a phthalocyanine, a cyanine, a psoralen, and a perylenequinonoid. In certain embodiments the photosensitizing agent is an agent shown in any of FIGS. 1-11.

Also provided is a chimeric construct comprising a targeting moiety attached to an antimicrobial peptide where the antimicrobial peptide comprises or consists of the amino acid or retro or inverso or retro-inverso sequence of a peptide found in Table 2. In certain embodiments the targeting moiety is a peptide that comprises or consists of the amino acid or retro or inverso or retro-inverso or beta sequence of a peptide found in Table 2, and/or Table 3, and/or Table 4, and/or Table 6, and/or Table 15. In certain embodiments, the targeting moiety comprises an antibody (e.g., an antibody identified in Table 5). In certain embodiments the targeting moiety is chemically conjugated to the effector directly or via a linker. In certain embodiments the targeting moiety is chemically conjugated to the effector via a linker comprising a polyethylene glycol (PEG). In certain embodiments the targeting moiety is chemically conjugated to the effector via a nonpeptide linker found in Table 11. In certain embodiments the where the targeting moiety is linked to the effector via a peptide linkage. In certain embodiments the chimeric construct is a fusion protein. In certain embodiments the linker is a peptide linker found in Table 11. In certain embodiments the chimeric moiety is functionalized with a polymer (e.g., polyethylene glycol, a cellulose, a modified cellulose, etc.) to increase serum halflife.

Also provided are pharmaceutical compositions comprising the chimeric construct(s)/chimeric moieties described herein in a pharmaceutically acceptable carrier. In certain embodiments the composition is formulated as a unit dosage formulation. In certain embodiments the composition is formulated for administration by a modality selected from the group consisting of intraperitoneal administration, topical administration, oral administration, inhalation administration, transdermal administration, subdermal depot administration, and rectal administration.

Also provided is an antimicrobial composition comprising an isolated antimicrobial moiety comprising or consisting of the amino acid sequence of a peptide found in Table 2. In certain embodiments the peptide comprises or consists of the amino acid or retro or inverso or retro-inverso sequence or beta sequence of a peptide found in Table 2. In certain embodiments the peptide is a peptide selected from the group consisting of a peptide consisting of the amino acid sequence of a peptide found in Table 2 comprising all L residues, a peptide consisting of the amino acid sequence of a peptide found in Table 2 comprising a peptide found in Table comprising all D residues, a peptide comprising the inverse of an amino acid sequence found in Table 2, a peptide comprising the retro-inverso form of a peptide found in Table 2, a peptide found in Table 2 comprising a conservative substitution, and a peptide found in Table 2 comprising a substitution of a naturally occurring amino acid with a non-naturally occurring amino acid. In certain embodiments the peptide comprises no more than 1, 2, 3, 4, 5, 6, 7, 8, 9, or 10 conservative substitutions.

Also provided is a composition comprising an isolated targeting moiety comprising or consisting of the amino acid sequence of a peptide found in Table 2 or Table 15. In certain embodiments the peptide comprises or consists of the amino acid or retro or inverso or retro-inverso sequence or beta sequence of a peptide found in Table 2 or Table 15. In certain embodiments the peptide is a peptide selected from the group consisting of a peptide consisting of the amino acid sequence of a peptide found in Table 2 or Table 15 comprising all L residues, a peptide consisting of the amino acid sequence of a peptide found in Table 2 comprising a peptide found in Table comprising all D residues, a peptide comprising the inverse of an amino acid sequence found in Table 2 or Table 15, a peptide comprising the retro-inverso form of a peptide found in Table 2 or Table 15, a peptide found in Table 2 or Table 15 comprising a conservative substitution, and a peptide found in Table 2 or Table 15 comprising a substitution of a naturally occurring amino acid with a non-naturally occurring amino acid. In certain embodiments the peptide comprises no more than 1, 2, 3, 4, 5, 6, 7, 8, 9, or 10 conservative substitutions.

In certain embodiments methods are provided for inhibiting the growth and/or proliferation of a microorganism and/or a biofilm comprising a microorganism. The methods typically involve contacting the microorganism or biofilm with a composition comprising an antimicrobial peptide comprising or consisting of the amino acid sequence of a peptide found in Table 2 (e.g., the amino acid or retro or inverso or retro-inverso sequence or beta sequence of a peptide found in Table 2); and/or contacting the microorganism or biofilm with a composition comprising an antimicrobial moiety attached to a targeting peptide comprising or consisting of the amino acid sequence of a peptide found in Table 2 (e.g., the amino acid or retro or inverso or retro-inverso sequence or beta sequence of a peptide found in Table 2). In certain embodiments the microorganism or biofilm is a bacterium or a bacterial film. In certain embodiments the targeting peptide is chemically conjugated to the antimicrobial peptide. In certain embodiments the targeting peptide is linked directly to the antimicrobial peptide. In certain embodiments the targeting peptide is linked to the antimicrobial peptide via a linker comprising a polyethylene glycol. In certain embodiments the targeting peptide is linked to the antimicrobial peptide via a non-peptide linkage in Table 11. In certain embodiments the targeting peptide is linked to the antimicrobial peptide via a peptide linkage. In certain embodiments the targeting peptide linked to the antimicrobial peptide is a fusion protein. In certain embodiments the linker is a peptide linker in Table 11.

In various embodiments methods are provided for detecting a microorganism (e.g., bacteria, yeast, protozoan, virus, algae, fungi, etc.) or biofilm comprising the microorganism. The methods typically involve contacting the microorganism or biofilm with a composition comprising a detectable label attached to a targeting peptide comprising the amino acid sequence of a peptide comprising or consisting of the amino acid or retro or inverso or retro-inverso sequence of a peptide found in Table 2; and detecting the detectable label where the quantity and/or location of the detectable label is an indicator of the presence of the microorganism and/or biofilm film. In certain embodiments the microorganism or biofilm is a bacterium or a bacterial film. In certain embodiments the detectable label is a label selected from the group consisting of a radioactive label, a radio-opaque label, a fluorescent dye, a fluorescent protein, an enzymatic label, a colorimetric label, and a quantum dot.

In certain embodiments compositions are also provided comprising a photosensitizing agent attached to a targeting peptide where the targeting peptide comprising or consisting of the amino acid or retro or inverso or retro-inverso sequence of a peptide found in Table 2 or Table 15. In certain embodiments the photosensitizing agent is an agent selected from the group consisting of a porphyrinic macrocycle, a porphyrin, a chlorine, a crown ether, an acridine, an azine, a phthalocyanine, a cyanine, a psoralen, and a perylenequinonoid. In certain embodiments the photosensitizing agent is an agent shown in any of FIGS. 1-11. In certain embodiments the photosensitizing agent is attached to the targeting peptide by a non-peptide linker. In certain embodiments photosensitizing agent is attached to the targeting peptide by a linker comprising a polyethylene glycol (PEG). In certain embodiments the photosensitizing agent is attached to the targeting peptide by a non-peptide linker found in Table 11.

In certain embodiments methods are provided for inhibiting the growth or proliferation of a microorganism and/or a biofilm (e.g., a bacterium and/or a bacterial film), where the methods involve contacting the a microorganism and/or a biofilm with a composition comprising a photosensitizing agent attached to a targeting peptide as described herein. In certain embodiments the method further comprises exposing the microorganism or biofilm to a light source. In certain embodiments the microorganism is a microorganism selected from the group consisting of a bacterium, a yeast, a fungus, a protozoan, and a virus. In certain embodiments the biofilm comprises a bacterial film.

In certain embodiments chimeric moieties are provided wherein the chimeric moiety comprises multiple targeting moieties attached to each other. In certain embodiments the targeting moieties are directly attached to each other. In certain embodiments the targeting moieties are attached to each other via a peptide linker. In certain embodiments the targeting moieties are attached to each other via a non-peptide linker. In certain embodiments chimeric moieties are provided wherein the chimeric moiety comprises multiple effectors attached to each other. In certain embodiments the effectors are directly attached to each other. In certain embodiments the effectors are attached to each other via a peptide linker. In certain embodiments the effectors are attached to each other via a non-peptide linker.

In certain embodiments chimeric moieties are provided where the chimeric moiety comprises one or more targeting moieties attached to one or more effectors. In certain embodiments the chimeric moiety comprises one or more of the targeting moieties shown in Table 2, and/or Table 4 and/or Table 6, and/or Table 15 attached to a single effector. In certain embodiments the chimeric moiety comprises one or more effectors attached to a single targeting moiety. In certain embodiments the chimeric moiety comprises one or more effectors comprising one or more of the antimicrobial peptides shown in Table 2, and/or Table 8, and/or Table 9, and/or Table 10 attached to a single targeting moiety. In certain embodiments the chimeric moiety comprises multiple targeting moieties attached to multiple effectors.

DEFINITIONS

The term "peptide" as used herein refers to a polymer of amino acid residues typically ranging in length from 2 to about 50 residues. In certain embodiments the peptide ranges in length from about 2, 3, 4, 5, 7, 9, 10, or 11 residues to about 50, 45, 40, 45, 30, 25, 20, or 15 residues. In certain embodiments the peptide ranges in length from about 8, 9, 10, 11, or 12 residues to about 15, 20 or 25 residues. Where an amino acid sequence is provided herein, L-, D-, or beta amino acid versions of the sequence are also contemplated as well as retro, inversion, and retro-inversion isoforms. Peptides also include amino acid polymers in which one or more amino acid residues is an artificial chemical analogue of a corresponding naturally occurring amino acid, as well as to naturally occurring amino acid polymers. In addition, the term applies to amino acids joined by a peptide linkage or by other, "modified linkages" (e.g., where the peptide bond is replaced by an α-ester, a β-ester, a thioamide, phosphonamide, carbomate, hydroxylate, and the like (see, e.g., Spatola, (1983) Chem. Biochem. Amino Acids and Proteins 7: 267-357), where the amide is replaced with a saturated amine (see, e.g., Skiles et al., U.S. Pat. No. 4,496,542, which is incorporated herein by reference, and Kaltenbronn et al., (1990) Pp. 969-970 in Proc. 11th American Peptide Symposium, ESCOM Science Publishers, The Netherlands, and the like)).

The term "residue" as used herein refers to natural, synthetic, or modified amino acids. Various amino acid analogues include, but are not limited to 2-aminoadipic acid, 3-aminoadipic acid, beta-alanine (beta-aminopropionic acid), 2-aminobutyric acid, 4-aminobutyric acid, piperidinic acid, 6-aminocaproic acid, 2-aminoheptanoic acid, 2-aminoisobutyric acid, 3-aminoisobutyric acid, 2-aminopimelic acid, 2,4 diaminobutyric acid, desmosine, 2,2'-diaminopimelic acid, 2,3-diaminopropionic acid, n-ethylglycine, n-ethylasparagine, hydroxylysine, allo-hydroxylysine, 3-hydroxyproline, 4-hydroxyproline, isodesmosine, allo-isoleucine, n-methylglycine, sarcosine, n-methylisoleucine, 6-n-methyllysine, n-methylvaline, norvaline, norleucine, ornithine, and the like. These modified amino acids are illustrative and not intended to be limiting.

"β-peptides" comprise of "β amino acids", which have their amino group bonded to the β carbon rather than the α-carbon as in the 20 standard biological amino acids. The only commonly naturally occurring β amino acid is β-alanine.

Peptoids, or N-substituted glycines, are a specific subclass of peptidomimetics. They are closely related to their natural peptide counterparts, but differ chemically in that their side chains are appended to nitrogen atoms along the molecule's backbone, rather than to the α-carbons (as they are in natural amino acids).

The terms "conventional" and "natural" as applied to peptides herein refer to peptides, constructed only from the naturally-occurring amino acids: Ala, Cys, Asp, Glu, Glu, Phe, Gly, His, Ile, Lys, Leu, Met, Asn, Pro, Gln, Arg, Ser, Thr, Val, Trp, and Tyr. A compound of the invention "corresponds" to a natural peptide if it elicits a biological activity (e.g., antimicrobial activity) related to the biological activity and/or specificity of the naturally occurring peptide. The elicited activity may be the same as, greater than or less than that of the natural peptide. In general, such a peptoid will have an essentially corresponding monomer sequence, where a natural amino acid is replaced by an N-substituted glycine derivative, if the N-substituted glycine derivative resembles the original amino acid in hydrophilicity, hydrophobicity, polarity, etc. Thus, for example, the following pairs of peptides would be considered "corresponding":

```
                                              (SEQ ID NO: 1)
Ia. Asp-Arg-Val-Tyr-Ile-His-Pro-Phe
(Angiotensin II)
and (SEQ ID NO: 2)
Ib. Asp-Arg-Val*-Tyr-Ile*-His-Pro-Phe;

(SEQ ID NO: 3)
IIa. Arg-Pro-Pro-Gly-Phe-Ser-Pro-Phe-Arg
(Bradykinin)
and (SEQ ID NO: 4)
IIb: Arg-Pro-Pro-Gly-Phe*-Ser*-Pro-Phe*-Arg;

(SEQ ID NO: 5)
IIIa: Gly-Gly-Phe-Met-Thr-Ser-Glu-Lys-Ser-Gln-Thr-
Pro-Leu-Val-Thr (β-Endorphin);
and (SEQ ID NO: 6)
IIIb: Gly-Gly-Phe*-Met-Ser*-Ser-Glu-Lys*-Ser-Gln-
Ser*-Pro-Leu-Val*-Thr.
```

In these examples, "Val*" refers to N-(prop-2-yl)glycine, "Phe*" refers to N-benzylglycine, "Ser*" refers to N-(2-hydroxyethyl)glycine, "Leu*" refers to N-(2-methylprop-1-yl) glycine, and "Ile*" refers to N-(1-methylprop-1-yl)glycine. The correspondence need not be exact: for example, N-(2-hydroxyethyl)glycine may substitute for Ser, Thr, Cys, and Met; N-(2-methylprop-1-yl)glycine may substitute for Val, Leu, and Ile. Note in IIIa and IIIb above that Ser* is used to substitute for Thr and Ser, despite the structural differences: the sidechain in Ser* is one methylene group longer than that of Ser, and differs from Thr in the site of hydroxy-substitution. In general, one may use an N-hydroxyalkyl-substituted glycine to substitute for any polar amino acid, an N-benzyl- or N-aralkyl-substituted glycine to replace any aromatic amino acid (e.g., Phe, Trp, etc.), an N-alkyl-substituted glycine such as N-butylglycine to replace any nonpolar amino acid (e.g., Leu, Val, Ile, etc.), and an N-(aminoalkyl)glycine derivative to replace any basic polar amino acid (e.g., Lys and Arg).

A "compound antimicrobial peptide" or "compound AMP" refers to a construct comprising two or more AMPs joined together. The AMPs can be joined directly or through a linker. They can be chemically conjugated or, where joined directly together or through a peptide linker can comprise a fusion protein.

In certain embodiments, conservative substitutions of the amino acids comprising any of the sequences described herein are contemplated. In various embodiments one, two, three, four, or five different residues are substituted. The term "conservative substitution" is used to reflect amino acid substitutions that do not substantially alter the activity (e.g., antimicrobial activity and/or specificity) of the molecule. Typically conservative amino acid substitutions involve substitution one amino acid for another amino acid with similar chemical properties (e.g. charge or hydrophobicity). Certain conservative substitutions include "analog substitutions" where a standard amino acid is replaced by a non-standard (e.g., rare, synthetic, etc) amino acid differing minimally from the parental residue. Amino acid analogs are considered to be derived synthetically from the standard amino acids without sufficient change to the structure of the parent, are isomers, or are metabolite precursors. Examples of such "analog substitutions" include, but are not limited to, 1) Lys-Orn, 2) Leu-Norleucine, 3) Lys-Lys[TFA], 4) Phe-Phe[Gly], and 5) δ-amino butylglycine-ξ-amino hexylglycine, where Phe[gly] refers to phenylglycine (a Phe derivative with a H rather than $CH_3$ component in the R group), and Lys[TFA] refers to a Lys where a negatively charged ion (e.g., TFA) is attached to the amine R group. Other conservative substitutions include "functional substitutions" where the general chemistries of the two residues are similar, and can be sufficient to mimic or partially recover the function of the native peptide. Strong functional substitutions include, but are not limited to 1) Gly/Ala, 2) Arg/Lys, 3) Ser/Tyr/Thr, 4) Leu/Ile/Val, 5) Asp/Glu, 6) Gln/Asn, and 7) Phe/Trp/Tyr, while other functional substitutions include, but are not limited to 8) Gly/Ala/Pro, 9) Tyr/His, 10) Arg/Lys/His, 11) Ser/Thr/Cys, 12) Leu/Ile/Val/Met, and 13) Met/Lys (special case under hydrophobic conditions). Various "broad conservative substations" include substitutions where amino acids replace other amino acids from the same biochemical or biophysical grouping. This is similarity at a basic level and stems from efforts to classify the original 20 natural amino acids. Such substitutions include 1) nonpolar side chains: Gly/Ala/Val/Leu/Ile/Met/Pro/Phe/Trp, and/or 2) uncharged polar side chains Ser/Thr/Asn/Gln/Tyr/Cys. In certain embodiments broad-level substitutions can also occur as paired substitutions. For example, any hydrophilic neutral pair [Ser, Thr, Gln, Asn, Tyr, Cys]+[Ser, Thr, Gln, Asn, Tyr, Cys] can may be replaced by a charge-neutral charged pair [Arg, Lys, His]+[Asp, Glu]. The following six groups each contain amino acids that are typical conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K), Histidine (H); 5) Isoleucine (I), Leucine (L), Methionine (M), Valine (V); and 6) Phenylalanine (F), Tyrosine (Y), Tryptophan (W).

In certain embodiments, targeting peptides, antimicrobial peptides, and/or STAMPs compromising at least 80%, preferably at least 85% or 90%, and more preferably at least 95% or 98% sequence identity with any of the sequences described herein are also contemplated. The terms "identical" or percent "identity," refer to two or more sequences that are the same or have a specified percentage of amino acid residues that are the same, when compared and aligned for maximum correspondence, as measured using one of the following sequence comparison algorithms or by visual inspection. With respect to the peptides of this invention sequence identity is determined over the full length of the peptide. For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters. Optimal alignment of sequences for comparison can be conducted, e.g., by the local homology algorithm of Smith & Waterman (1981) *Adv. Appl. Math.* 2: 482, by the homology alignment algorithm of Needleman & Wunsch (1970) *J. Mol. Biol.* 48: 443, by the search for similarity method of Pearson & Lipman (1988) *Proc. Natl. Acad. Sci.*, USA, 85: 2444, by computerized implementations of these algorithms (GAP, BESTFIT, FASTA, and TFASTA in the Wisconsin Genetics Software Package, Genetics Computer Group, 575 Science Dr., Madison, Wis.), or by visual inspection.

The term "specificity" when used with respect to the antimicrobial activity of a peptide indicates that the peptide preferentially inhibits growth and/or proliferation and/or kills a particular microbial species as compared to other related and/or unrelated microbes. In certain embodiments the preferential inhibition or killing is at least 10% greater (e.g., $LD_{50}$ is 10% lower), preferably at least 20%, 30%, 40%, or 50%, more preferably at least 2-fold, at least 5-fold, or at least 10-fold greater for the target species.

"Treating" or "treatment" of a condition as used herein may refer to preventing the condition, slowing the onset or rate of development of the condition, reducing the risk of developing the condition, preventing or delaying the development of symptoms associated with the condition, reducing or ending symptoms associated with the condition, generating a complete or partial regression of the condition, or some combination thereof.

The term "consisting essentially of" when used with respect to an antimicrobial peptide (AMP) or AMP motif as described herein, indicates that the peptide or peptides encompassed by the library or variants, analogues, or derivatives thereof possess substantially the same or greater antimicrobial activity and/or specificity as the referenced peptide. In certain embodiments substantially the same or greater anti-microbial activity indicates at least 80%, preferably at least 90%, and more preferably at least 95% of the anti microbial activity of the referenced peptide(s) against a particular bacterial species (e.g., *S. mutans*).

The term "porphyrinic macrocycle" refers to a porphyrin or porphyrin derivative. Such derivatives include porphyrins with extra rings ortho-fused, or orthoperifused, to the porphyrin nucleus, porphyrins having a replacement of one or more carbon atoms of the porphyrin ring by an atom of another element (skeletal replacement), derivatives having a replacement of a nitrogen atom of the porphyrin ring by an atom of another element (skeletal replacement of nitrogen), derivatives having substituents other than hydrogen located at the peripheral (meso-, .beta.-) or core atoms of the porphyrin, derivatives with saturation of one or more bonds of the porphyrin (hydroporphyrins, e.g., chlorins, bacteriochlorins, isobacteriochlorins, decahydroporphyrins, corphins, pyrrocorphins, etc.), derivatives obtained by coordination of one or more metals to one or more porphyrin atoms (metalloporphyrins), derivatives having one or more atoms, including pyrrolic and pyrromethenyl units, inserted in the porphyrin ring (expanded porphyrins), derivatives having one or more groups removed from the porphyrin ring (contracted porphyrins, e.g., corrin, corrole) and combinations of the foregoing derivatives (e.g. phthalocyanines, porphyrazines, naphthalocyanines, subphthalocyanines, and porphyrin isomers). Certain porphyrinic macrocycles comprise at least one 5-membered ring.

As used herein, an "antibody" refers to a protein consisting of one or more polypeptides substantially encoded by immunoglobulin genes or fragments of immunoglobulin genes. The recognized immunoglobulin genes include the kappa, lambda, alpha, gamma, delta, epsilon and mu constant region genes, as well as myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively.

A typical immunoglobulin (antibody) structural unit is known to comprise a tetramer. Each tetramer is composed of two identical pairs of polypeptide chains, each pair having one "light" (about 25 kD) and one "heavy" chain (about 50-70 kD). The N-terminus of each chain defines a variable region of about 100 to 110 or more amino acids primarily responsible for antigen recognition. The terms variable light chain ($V_L$) and variable heavy chain ($V_H$) refer to these light and heavy chains respectively.

Antibodies exist as intact immunoglobulins or as a number of well characterized fragments produced by digestion with various peptidases. Thus, for example, pepsin digests an antibody below the disulfide linkages in the hinge region to produce F(ab)'$_2$, a dimer of Fab which itself is a light chain joined to $V_H$-$C_H$1 by a disulfide bond. The F(ab)'$_2$ may be reduced under mild conditions to break the disulfide linkage in the hinge region thereby converting the (Fab')$_2$ dimer into an Fab' monomer. The Fab' monomer is essentially an Fab with part of the hinge region (see, *Fundamental Immunology*, W. E. Paul, ed., Raven Press, N.Y. (1993), for a more detailed description of other antibody fragments). While various antibody fragments are defined in terms of the digestion of an intact antibody, one of skill will appreciate that such Fab' fragments may be synthesized de novo either chemically or by utilizing recombinant DNA methodology. Thus, the term antibody, as used herein also includes antibody fragments either produced by the modification of whole antibodies or synthesized de novo using recombinant DNA methodologies, including, but are not limited to, Fab'$_2$, IgG, IgM, IgA, scFv, dAb, nanobodies, unibodies, and diabodies.

In certain embodiments antibodies and fragments of the present invention can be bispecific. Bispecific antibodies or fragments can be of several configurations. For example, bispecific antibodies may resemble single antibodies (or antibody fragments) but have two different antigen binding sites (variable regions). In various embodiments bispecific antibodies can be produced by chemical techniques (Kranz et al. (1981) *Proc. Natl. Acad. Sci., USA*, 78: 5807), by "polydoma" techniques (see, e.g., U.S. Pat. No. 4,474,893), or by recombinant DNA techniques. In certain embodiments bispecific antibodies of the present invention can have binding specificities for at least two different epitopes, at least one of which is an epitope of a microbial organism. The microbial binding antibodies and fragments can also be heteroantibodies. Heteroantibodies are two or more antibodies, or antibody binding fragments (e.g., Fab) linked together, each antibody or fragment having a different specificity.

The term "STAMP" refers to Specifically Targeted Anti-Microbial Peptides. An MH-STAMP is a STAMP bearing two or more targeting domains (i.e., a multi-headed STAMP).

In various embodiments the amino acid abbreviations shown in Table 1 are used herein.

TABLE 1

Amino acid abbreviations.

| Name | Abbreviation | |
|---|---|---|
| | 3 Letter | 1 Letter |
| Alanine | Ala | A |
| βAlanine (NH$_2$—CH$_2$—CH$_2$—COOH) | βAla | |
| Arginine | Arg | R |
| Asparagine | Asn | N |
| Aspartic Acid | Asp | D |
| Cysteine | Cys | C |
| Glutamic Acid | Glu | E |

TABLE 1-continued

Amino acid abbreviations.

| Name | Abbreviation | |
|---|---|---|
| | 3 Letter | 1 Letter |
| Glutamine | Gln | Q |
| Glycine | Gly | G |
| Histidine | His | H |
| Homoserine | Hse | — |
| Isoleucine | Ile | I |
| Leucine | Leu | L |
| Lysine | Lys | K |
| Methionine | Met | M |
| Methionine sulfoxide | Met (O) | — |
| Methionine methylsulfonium | Met (S-Me) | — |
| Norleucine | Nle | — |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |
| epsilon-aminocaproic acid (NH$^2$—(CH$_2$)$_5$—COOH) | Ahx | J |
| 4-aminobutanoic acid (NH$_2$(CH$_2$)$_3$—COOH) | gAbu | |
| tetrahydroisoquinoline-3-carboxylic acid | | O |
| Lys(N(epsilon)-trifluoroacetyl) | | K[TFA] |
| α-aminoisobutyric acid | Aib | B |

BRIEF DESCRIPTION OF THE DRAWINGS

FIG. 2 shows some illustrative porphyrins (compounds 100-118) suitable for use as targeting moieties and/or antimicrobial effectors.

FIG. 7 shows illustrative psoralen (angelicin) photosensitizers suitable for use as targeting moieties and/or antimicrobial effectors in the compositions and methods described herein.

FIG. 8 shows illustrative hypericin and the perylenequinonoid pigments suitable for use as targeting moieties and/or antimicrobial effectors in the compositions and methods described herein.

FIG. 12 schematically shows some illustrative configurations for chimeric constructs described herein. A: Shows a single targeting moiety T1 attached to a single effector E1 by a linker/spacer L. B: Shows multiple targeting moieties T1, T2, T3 attached directly to each other and attached by a linker L to a single effector E1. In various embodiments T1, T2, and T3, can be domains in a fusion protein. C: Shows multiple targeting moieties T1, T2, T3 attached to each other by linkers L and attached by a linker L to a single effector E1. In various embodiments T1, T2, and T3, can be domains in a fusion protein. D: Shows a single targeting moiety T1 attached by a linker L to multiple effectors E1, E2, and E3 joined directly to each other. E: Shows a single targeting moiety T1 attached by a linker L to multiple effectors E1, E2, and E3 joined to each other by linkers L. F: Shows multiple targeting moieties joined directly to each other and by a linker L to multiple effectors joined to each other by linkers L. G: Shows multiple targeting moieties joined to each other by linkers L and by a linker L to multiple effectors joined to each other by linkers L. In various embodiments T1, T2, and T3, and/or E1, E2, and E3 can be domains in a fusion protein. H: Illustrates a branched configuration where multiple targeting moieties are linked to a single effector. I: Illustrates a dual branched configuration where multiple targeting moieties are linked to multiple effectors. J: Illustrates a branched configuration where multiple targeting moieties are linked to multiple effectors where the effectors are joined to each other in a linear configuration.

FIG. 13 illustrates various MH-STAMPs used in Example 1. The design, sequence, and observed mass (m/z) for M8(KH)-20, BL(KH)-20, and M8(BL)-20.

FIG. 17 depicts the results of minimal inhibitory concentration (MIC) assays, conducted against S. mutans and a panel of bacteria, including two oral streptococci, S. sanguinis and S. sobrinus, to gauge Library 1 STAMP (SEQ ID NOS:1969-1976) antimicrobial activity and S. mutans-selectivity.

FIG. 18 shows the results of MIC assays of STAMPs comprising targeting peptide 2_1 conjugated to one of five AMPs: RWRWRWF (2c-4; SEQ ID NO:1860), FKKFWK-WFRRF (B-33; SEQ ID NO:1821), IKQLLHFFQRF (B-38; SEQ ID NO:1826), RWRRLLKKLHHLLH (α-11; SEQ ID NO:1877), and LQLLKQLLKLLKQF (α-7; SEQ ID NO:1873. Each targeting peptide is attached at the C- or N-terminus to an AMP utilizing a linker selected from: L1, SGG (L6; SEQ ID NO:1938), L3, and LC. The linkers in FIG. 18 are designated by their abbreviation and shown in parenthesis in the STAMP name (e.g. "2 1(L1)$_2$C-4"). MIC assays were conducted against a panel of bacteria, including S. mutans (S. mu), S. gordonii (S. gor), S. sanguinis (S. san), and S. mitis (S. mit), to gauge differences in activity between attaching the targeting peptide to the C- or N-terminus of the AMP region or differences in activity between the linker used.

DETAILED DESCRIPTION

Figure 1:
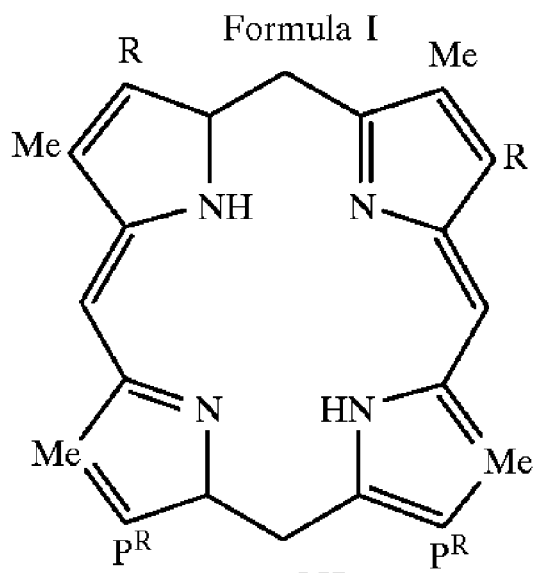
FIG. 1 shows some illustrative porphyrins (compounds 92-99) suitable for use as targeting moieties and/or antimicrobial effectors.
Figure 3:
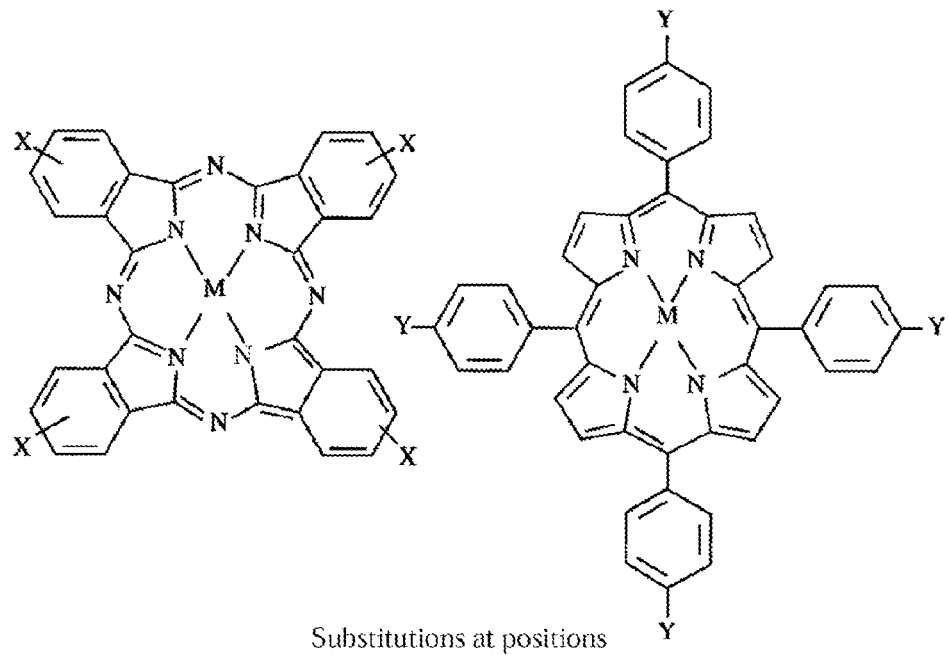
FIG. 3 shows some illustrative porphyrins (in particular phthalocyanines) (compounds 119-128) suitable for use as targeting moieties and/or antimicrobial effectors.
Figure 4:
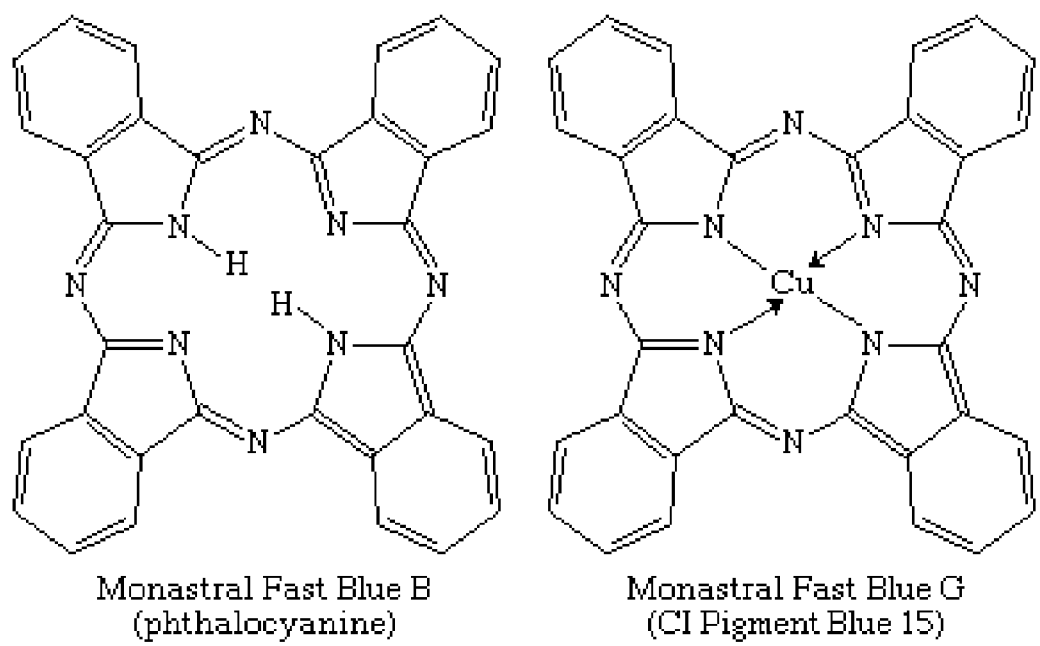
FIG. 4 illustrates the structures of two phthalocyanines, Monoastral Fast Blue B and Monoastral Fast Blue G suitable for use as targeting moieties and/or antimicrobial effectors.
Figure 5:
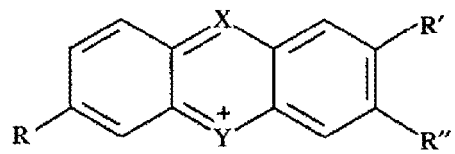
FIG. 5 illustrates certain azine photosensitizers suitable for use as targeting moieties and/or antimicrobial effectors in the compositions and methods described herein.
Figure 6:
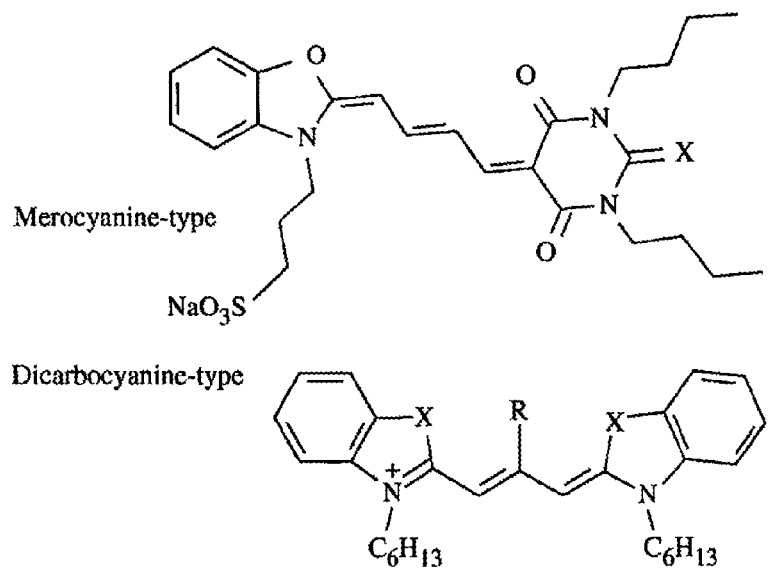
FIG. 6 shows illustrative cyanine suitable for use as targeting moieties and/or antimicrobial effectors in the compositions and methods described herein.
Figure 9:
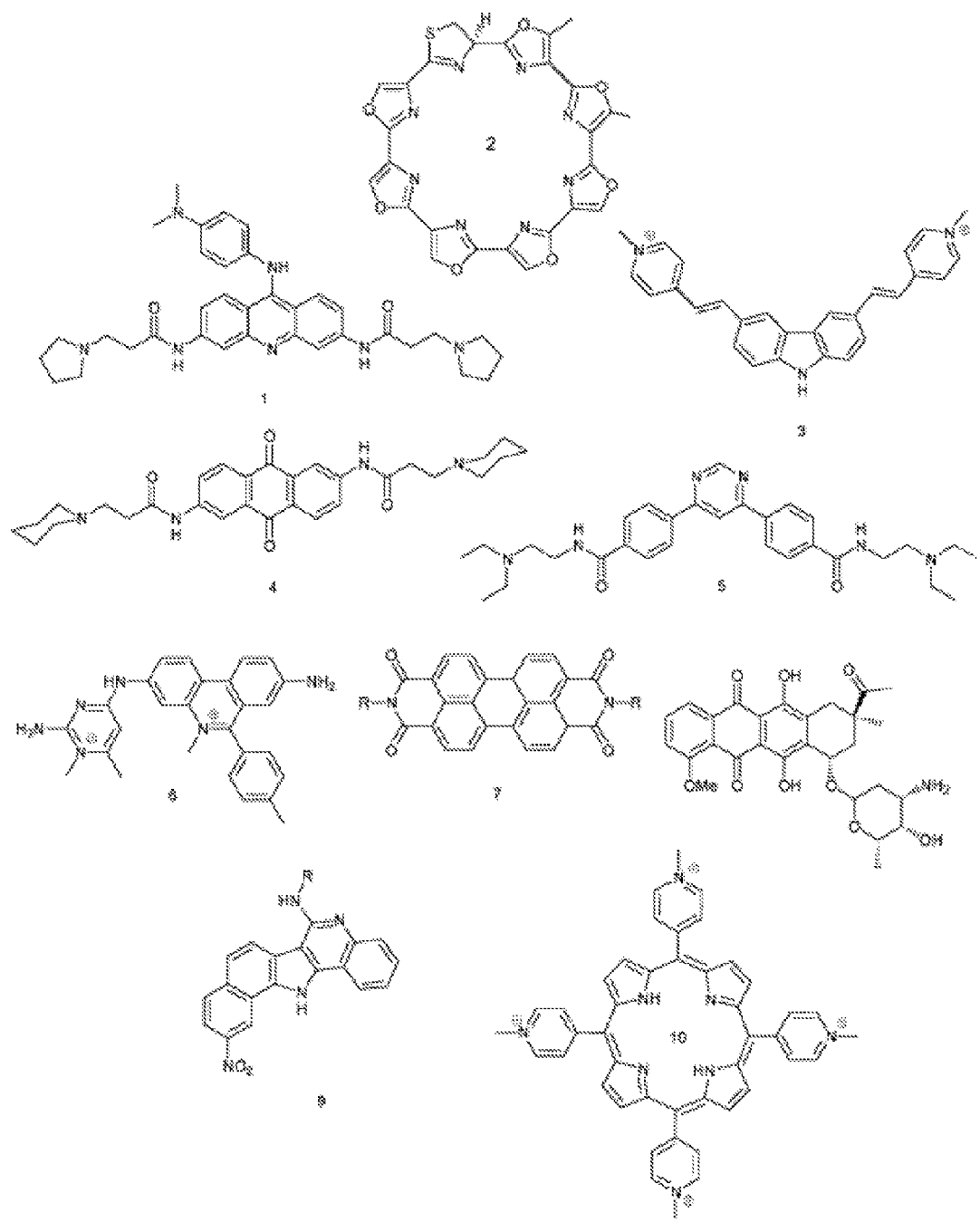
FIG. 9 shows illustrative acridines suitable for use as targeting moieties and/or antimicrobial effectors in the compositions and methods described herein.
Figure 10:
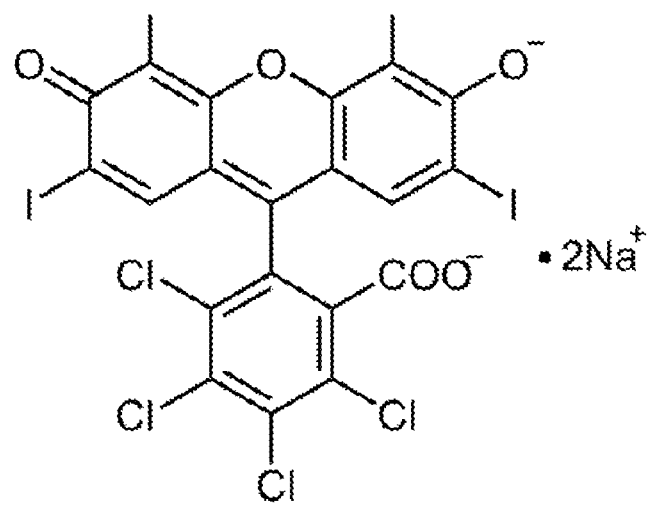
FIG. 10 illustrates the structure of the acridine Rose Bengal.
Figure 11:
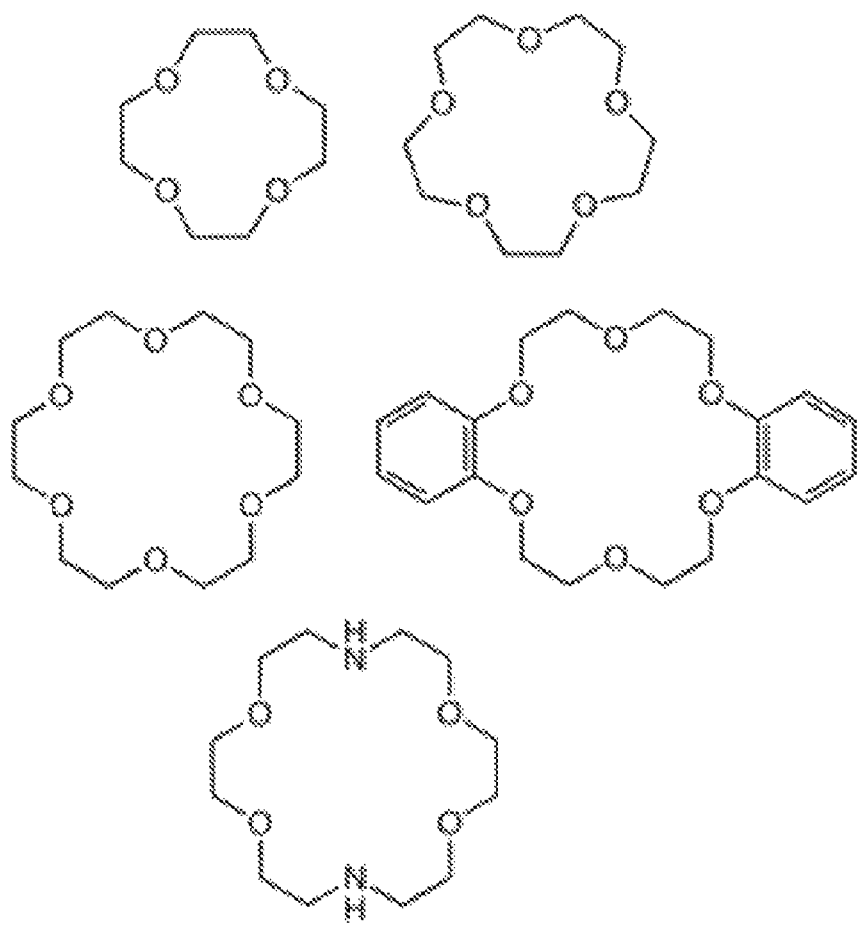
FIG. 11 illustrates various crown ethers suitable for use as targeting moieties and/or antimicrobial effectors in the compositions and methods described herein.

In various embodiments this invention is based on the development of a method for the rapid identification and synthesis of small peptides from sequenced genomes for the purposes of quickly screening these molecules for diverse biological activities. Previously, small secreted peptides had to be identified by direct collection (purification of spent microbial growth medium or biological tissue/fluid), or by identification through differential microarray analysis or as a by-product of genetic operon characterization. Both are multi-step processes that terminate at peptide identification; several separate enterprises are required to synthesize or sequence any peptides for characterization. Additionally, because of their small size and lack of protein domain homologies, small peptides are frequently overlooked when describing biological systems, though many organisms contain numerous peptide-sized open reading frames (ORFs).

Genomic sequence analysis tools already in the public domain and high-throughput solid phase peptide chemistry were used to rapidly identify and synthesize biologically active peptides. Using sequences and sometimes annotated genomes, genomes were scanned, by hand or with a search algorithm, for ORFs predicted to encode peptides of less than for example, 50-60 amino acids (ignoring small tRNA ORFs or other well characterized genes).

Once noted, these peptides were batch synthesized on a multiplex peptide synthesizer, yielding 5-10 mg of each peptide that could readily be screened for biological activity (e.g., binding activity and/or antimicrobial activity.

Accordingly, in certain embodiments, this invention pertains to the identification of novel peptides (see, e.g., Table 2) that specifically or preferentially bind particular microorganisms (e.g., bacteria) and/or that have antimicrobial activity. In certain embodiments these peptides can be attached to effectors (e.g., drugs, labels, etc.) and used as targeting moieties thereby providing a chimeric moiety that preferentially or specifically delivers the effector to a target microorganism, a population of target microorganisms, a microbial film comprising the target microorganism(s), a biofilm comprising the target microorganism(s), and the like.

In certain embodiments these peptides can be exploited for their antimicrobial activity to inhibit the growth or proliferation of a microorganism and/or to inhibit the formation and/or growth of a biofilm comprising the microorganism. These antimicrobial peptides can be used alone, in conjunction with other agents (e.g., antibacterial agents), and/or they can be coupled to a targeting moiety to provide a chimeric moiety that preferentially directs the antimicrobial peptide to a target tissue and/or to a target organism (e.g., a bacterium, a population of target microorganisms, a microbial film, a biofilm, and the like).

In certain embodiments the antimicrobial peptides and/or the chimeric moieties described herein can be formulated with a pharmaceutically acceptable carrier to form a pharmacological composition.

The amino acid sequences of illustrative peptides of this invention having antimicrobial and/or targeting activity against methicillin resistant *Streptococcus mutans*, *Streptococcus pyogenes*, and/or *Treponema denticola* is shown in Table 2. As with the other peptides described herein, it will be recognized that these peptides can comprise all "L" form residues, all "D" form residues, mixtures of "L" and "D" residues, and beta peptide sequences. It will also be appreciated in addition to the D-form and L-form and beta-peptide sequences this invention also contemplates retro and retro-inverso forms of each of these peptides. In retro forms, the direction of the sequence is reversed. In inverse forms, the chirality of the constituent amino acids is reversed (i.e., L form amino acids become D form amino acids and D form amino acids become L form amino acids). In the retro-inverso form, both the order and the chirality of the amino acids is reversed. Thus, for example, a retro form of the of the peptide Smu11 (MKNLIETVEKFLTYSDEKLEELAKKN-QALREEISRQKSK, SEQ ID NO:11) has the sequence KSKQRSIEERLAQNKKALEELKED-SYTLFKEVTEILNKM (SEQ ID NO:10). Where the Smu11 peptide comprises all L amino acids, the inverse form will comprise all D amino acids and the retro-inverso (retro-inverse) form will have the sequence of SEQ ID NO:10 and comprise all D form amino acids. Also contemplated are peptides having the amino acid sequences or retro amino acid sequences of the peptides in Table 2 (or the other tables shown herein) and comprising one, two, three, four, five, six, seven, eight, nine, or ten conservative substitutions, but retaining substantially the same binding and/or antimicrobial activity. Also contemplated are peptides having the amino acid sequences or retro amino acid sequences of the peptides in Table 2 (or other tables herein) and comprising one, two, three, four, five, six, seven, eight, nine, or ten deletions, but retaining substantially the same binding and/or antimicrobial activity.

In various embodiments, chimeric moieties comprising one or more of the targeting peptides found in Table 2 attached to one or more effectors (e.g., antimicrobial peptides as described herein) are contemplated. In various embodiments, one or more of the antimicrobial peptides found in Table 2 used as effectors or attached to one or more targeting moieties (e.g., targeting peptides, targeting antibodies, and the like) to form chimeric moieties are contemplated.

TABLE 2

Peptides having antimicrobial and/or targeting activity against one or more of the following: *Streptococcus mutans*, *Streptococcus pyogenes*, and *Treponema denticola*.

| ID | Amino Acid Sequence | SEQ ID NO |
|---|---|---|
| Smu11 | MKNLIETVEKFLTYSDEKLEELAKKNQALREEISRQKSK | 11 |
| Smu.18 | GGRAGRIKKLSQKEAEPFEN | 12 |
| Smu41 | MFIRSKLRRVDFSGVRRGNKHFLLDKLLITLVK | 13 |
| Smu68 | MSALFYDTLAAIWISIAGVDARWGH | 14 |
| Smu150 | GGKVSGGEAVAAIGICATASAAIGGLAGATLVTPYCVGTWGLIRSH | 15 |
| Smu151 | DKQAADTFLSAVGGAASGFTYCASNGVWHPYILAGCAGVGAVGSVVFPH | 16 |
| Smu223c | GGKYLFLASKTKEYFKSHFREIMIDV | 17 |
| Smu225c | MFISFVDCIQNIEKIEKELLKIGITDIQINQDAGWLY | 18 |
| Smu277 | YLTEIEGEGLGLGICLGLVGFAGGFAHGVVQGAGVGTAIEPGYGTIIGALVDGVGQDLIYGGAGFAAGYSL | 19 |
| Smu283 | GGFDVKGVAASYLAMGTAALGGLACTTPVGAVLYLGAEVCAGAAVIYYGAN | 20 |
| Smu299c | GGGLYDGANGYAYRDSQGHWAYKVTKTPAQALTDVVVNSWASGAASFAAYA | 21 |

TABLE 2-continued

Peptides having antimicrobial and/or targeting activity against one or more of the following: *Streptococcus mutans*, *Streptococcus pyogenes*, and *Treponema denticola*.

| ID | Amino Acid Sequence | SEQ ID NO |
|---|---|---|
| Smu390 | GGRSSYNGFSKICFLKIEHFGSYSYQGR | 22 |
| Smu423 | GGGMIRCALGTAGSAGLGFVGGMGAGTVTLPVVGTVSGAAL GGWSGAAVGAATFC | 23 |
| Smu427 | MEKTYHIDGLKCQGCADNVTKRFSELKKVNDVKVDLDKKEV RITGNPSKWSLKRALKGTNYELGAEI | 24 |
| Smu444 | MSVGMGVIERGSFDFSASAILQKRETKCLKNKPFT | 25 |
| Smu451 | MKMRAGQVVFIYKLILVLLFYVLQKLFDLKKGCF | 26 |
| Smu529 | MLPDSALDERIKGRVSAKNSSLLSALIKKLALIIFIG | 27 |
| Smu616 | GGVATYGAATMGLCAVSGPIGWGLGGAYLLTCAAAGGMIGY GAATLD | 28 |
| Smu750c | MLSNVLSRSVVSPNVDIPNSMVILSPLLISISNYH | 29 |
| Smu812 | MAILTFFMALLFTYLKEKAQILYWPLFLHLMFYFVTA | 30 |
| Smu1018 | MNTNDLLQAFELMGLGMAGVFIVLGILYIVAELLIKIFPVNN | 31 |
| Smu1047c | MVHLFSFVKLIYYDIMKYSIEEKVFFESPVGEIIQ | 32 |
| Smu1131c | GGYATAKLTQTKPTMPKNVKKGTPPKGAPEDTPPNGNSNDSS QSDSDSDSNSSNTNSNSSITNG | 33 |
| Smu1231c | MDKKRVIERIKSFSLRDEVIHFGELCIYWGK | 34 |
| Smu1232c | GGKNKLVMSDLRQQVTDMGFVNVKTYINSGNLFFQSDCPRAN ISSRFEQFFADHYPFV | 35 |
| Smu1358 | MNNAYRWFFRLTLADNMHRFTTYGKEWQLSFPK | 36 |
| Smu1359 | MKLAGIEKKINLSKRRKLYLENSSLLINYVKVNMSY | 37 |
| Smu1368 | MTEILNFLIAVHDDRKNWKIKHCLSNSSFDFLCSPDSSR | 38 |
| Smu1369 | MPVQKALHVVSAYATDLGICYDQVVTVMIREVKTQLYQIY | 39 |
| Smu1372c | GGSYQQVYSWVRKFKKDGINGLLDRRGKGLESKLISVVMVAI VLRPV | 40 |
| Smu1504c | GGMSSGWLSDDFWLKSAIPLLKKRLAKWNETL | 41 |
| Smu1505c | MAYSLTFQNPNDNLTDEEVAKYMEKITKALTEKIGAEVR | 42 |
| Smu1719c | MNTFLWILLVIIALLAGLVGGTFIARKQMEKYLEENPPLNEDVI RNMMSQMGQKPSEAKVQQVVRQMNKQQKAAKAKAKKKK | 43 |
| Smu1750c | MIFNRRKFFQYFGLSKEAMVEHIQPFILDIWQIHLF | 44 |
| Smu1752c | GGWLNAISLYGRIG | 45 |
| Smu1768c | GGHKQLVIEPLVSQNDQLSLIESLSGILSDSETVDVKDYRSERK EERLKKYESLT | 46 |
| Smu1808c | MTTTQKTYLHIIRELENQDIDLIMRSLTSLT | 47 |
| Smu1813 | MPMTYCGSPRRTDLAVITDEELGQTLEVINHWPRNV | 48 |
| Smu1882c | GGATDGEIIANRMLQGKATKGEITMYTWNIIQNGWVNSLVSW GIGGYNSSIGYSAQGNRGFSNYPYDVSMDSDNSSSSSNTTGGY VNYNQSFNSGW | 49 |
| Smu1889c | GGLAGAGTGAAVSAPAAEGGGLGPIAGAAIGWDLGAISGAGL GWANFCQ | 50 |
| Smu1895c | GGMTWAEIGAIVGATIGSFYIPNPVIVPFRVR | 51 |

TABLE 2-continued

Peptides having antimicrobial and/or targeting activity against one or more of the following: *Streptococcus mutans*, *Streptococcus pyogenes*, and *Treponema denticola*.

| ID | Amino Acid Sequence | SEQ ID NO |
|---|---|---|
| Smu1896c | GGFGWDSIWRGFKCVAGTAGTIGTGALGGSATGGLTLPIIGHVSGGIIGGISGAGVGIASFC | 52 |
| Smu1899 | MLSISQRTDRVIVMDKGKIIEEGTHSELIAANGFYHHLFNK | 53 |
| Smu1902c | GGAFYQRKENVISLDPREWLGFNVTEK | 54 |
| Smu1903c | GGNIFEYFLE | 55 |
| Smu1905c | GGGRAPRCAALVGASIYDGLAVVGDPVGVAMAAGTIAAGSFC | 56 |
| Smu1906c | GGCSWKGADKAGFSGGVGGLIGAGGNPVGGVLGIAGGLDAYGELVGGN | 57 |
| Smu1907 | MEQNILNGSYFVLNGKNAKFLLEIDKLTLPDKLATLPVPHQVR | 58 |
| Smu1914c | GGGRGWNCAAGIALGAGQGYMATAGGTAFLGPYAIGTGAFGAIAGGIGGALNSCG | 59 |
| Smu1915 | GGSGSLSTFFRLFNRSFTQALGK | 60 |
| Smu1948 | GGVFSVLKHTTWPTRKQSWHDFISILEYSAFFALVIFIFDKLLTLGLAELLKRF | 61 |
| Smu1968c | GGSVLGKHALFILLKAGFKAYELAGAFEGWKGMHLPTEKC | 62 |
| Smu1972c | GGLVMNDETIYLFTYENGQISYEEDKRDCSKNV | 63 |
| Smu2105 | MRFLKDELSVSVRLQEKSIEALPFRTKIEIEIESDNQIKTL | 64 |
| Smu2106c | GGASGEKILEKLIHERKCQLTQNRQIVLKTDLNNLMKDFYK | 65 |
| Smu2121c | GGIILAKAADLAEIERIISEDPFKINEIANYDIIEFCPTKSSKAFEKVLK | 66 |

Uses of Targeting Moieties.

When exploited for their targeting activity, the novel targeting peptides described herein (see, e.g., Table 2) can be used to preferentially or specifically deliver an effector to a microorganism (e.g., a bacterium, a fungus, a protozoan, a yeast, an algae, etc.), to a bacterial film comprising the microorganism, to a biofilm comprising the microorganism, and the like. Where the effector comprises an epitope tag and/or a detectable label, binding of the targeting moiety provides an indication of the presence and/or location, and/or quantity of the target (e.g., target microorganism). Thus targeting moieties are thus readily adapted for use in in vivo diagnostics, and/or ex vivo assays. Moreover, because of small size and good stability, the microorganism binding peptides are well suited for microassay systems (e.g., microfluidic assays (Lab on a Chip), microarray assays, and the like).

In certain embodiments the microorganism binding peptides (targeting peptides) can be attached to an effector that has antimicrobial activity (e.g., an antimicrobial peptide, an antibacterial and/or antifungal, a vehicle that contains an antibacterial or antifungal, etc. In various embodiments these chimeric moieties can be used in vivo, or ex vivo to preferentially inhibit or kill the target organism(s).

In certain embodiments the targeting peptides can be used in various pre-targeting protocols. In pre-targeting protocols, a chimeric molecule is utilized comprising a primary targeting species (e.g. a microorganism-binding peptide) that specifically binds the desired target (e.g. a bacterium) and an effector that provides a binding site that is available for binding by a subsequently administered second targeting species. Once sufficient accretion of the primary targeting species (the chimeric molecule) is achieved, a second targeting species comprising (i) a diagnostic or therapeutic agent and (ii) a second targeting moiety, that recognizes the available binding site of the primary targeting species, is administered.

An illustrative example of a pre-targeting protocol is the biotin-avidin system for administering a cytotoxic radionuclide to a tumor. In a typical procedure, a monoclonal antibody targeted against a tumor-associated antigen is conjugated to avidin and administered to a patient who has a tumor recognized by the antibody. Then the therapeutic agent, e.g., a chelated radionuclide covalently bound to biotin, is administered. The radionuclide, via its attached biotin is taken up by the antibody-avidin conjugate pretargeted at the tumor. Examples of pre-targeting biotin/avidin protocols are described, for example, in Goodwin et al., U.S. Pat. No. 4,863,713; Goodwin et al. (1988) *J. Nucl. Med.* 29: 226; Hnatowich et al. (1987) *J. Nucl. Med.* 28: 1294; Oehr et al. (1988) *J. Nucl. Med.* 29: 728; Klibanov et al. (1988) *J. Nucl. Med.* 29: 1951; Sinitsyn et al. (1989) *J. Nucl. Med.* 30: 66; Kalofonos et al. (1990) *J. Nucl. Med.* 31: 1791; Schechter et al. (1991) *Int. J. Cancer* 48:167; Paganelli et al. (1991) *Cancer Res.* 51: 5960; Paganelli et al. (1991) *Nucl. Med. Commun.* 12: 211; Stickney et al. (1991) *Cancer Res.* 51: 6650; and Yuan et al. (1991) *Cancer Res.* 51:3119.

It will be recognized that the tumor-specific antibody used for cancer treatments can be replaced with a microorganism binding peptide of the present invention and similar pre-targeting strategies can be used to direct labels, antibiotics, and the like to the target organism(s).

Three-step pre-targeting protocols in which a clearing agent is administered after the first targeting composition has localized at the target site also have been described. The clearing agent binds and removes circulating primary conjugate which is not bound at the target site, and prevents circulating primary targeting species (antibody-avidin or conjugate, for example) from interfering with the targeting of active agent species (biotin-active agent conjugate) at the target site by competing for the binding sites on the active agent-conjugate. When antibody-avidin is used as the primary targeting moiety, excess circulating conjugate can be cleared by injecting a biotinylated polymer such as biotinylated human serum albumin. This type of agent forms a high molecular weight species with the circulating avidin-antibody conjugate which is quickly recognized by the hepatobiliary system and deposited primarily in the liver.

Examples of these protocols are disclosed, e.g., in PCT Application No. WO 93/25240; Paganelli et al. (1991) *Nucl. Med. Comm.*, 12: 211-234; Oehr et al. (1988) *J. Nucl. Med.*, 29: 728-729; Kalofonos et al. (1990) *J. Nucl. Med.*, 31: 1791-1796; Goodwin et al. (1988) *J. Nucl. Med.*, 29: 226-234; and the like).

These applications of microorganism binding peptides of this invention are intended to be illustrative and not limiting. Using the teaching provided herein, other uses will be recognized by one of skill in the art.

Uses of Antimicrobial Peptides.

When exploited for their antimicrobial activity, the novel antimicrobial peptides described herein (see, e.g., Table 2) can be used to inhibit the growth and/or proliferation of a microbial species and/or the growth or proliferation of a biofilm comprising the microbial species. In various embodiments the peptides can be formulated individually, in combination with each other, in combination with other antimicrobial peptides, and/or in combination with various antibacterial agents to provide antimicrobial reagents and/or pharmaceuticals.

In various embodiments, the antimicrobial peptides described herein can be formulated individually, in combination with each other, in combination with other antimicrobial peptides, and/or in combination with various antibiotic (e.g., antibacterial) agents in "home healthcare" formulations. Such formulations include, but are not limited to toothpaste, mouthwash, tooth whitening strips or solutions, contact lens storage, wetting, or cleaning solutions, dental floss, toothpicks, toothbrush bristles, oral sprays, oral lozenges, nasal sprays, aerosolizers for oral and/or nasal application, wound dressings (e.g., bandages), and the like.

In various embodiments the antimicrobial peptides described herein can be formulated individually, in combination with each other, in combination with other antimicrobial peptides, and/or in combination with various antibiotic (e.g., antibacterial) agents in various cleaning and/or sterilization formulations for use in the home, workplace, clinic, or hospital.

In certain embodiments the antimicrobial peptides described herein are attached to one or more targeting moieties to specifically and/or to preferentially deliver the peptide(s) to a target (e.g. a target microorganism, biofilm, bacterial film, particular tissue, etc.).

Other possible uses of the targeting and/or antimicrobial peptides disclosed herein include, but are not limited to biofilm dispersal, biofilm retention, biofilm formation, anti-biofilm formation, cell agglutination, induction of motility or change in motility type, chemoattractant or chemorepellent, extracellular signal for sporogenesis or other morphological change, induction or inhibition of virulence gene expression, utilized as extracellular scaffold, adhesin or binding site, induction or suppression of host immune response, induction or suppression of bacterial/fungal antimicrobial molecule production, quorum-sensing, induction of swarming behavior, apoptosis or necrosis inducing in eukaryotic cells, affecting control of or inducing the initiation of cell cycle in eukaryotes, in archaea or prokaryotes, induces autolysis or programmed cell death, inhibition of phage/virus attachment or replication, evasion of innate immunity, induction or inhibition of genetic transformation or transduction competence, induction or inhibition of pilus-mediated conjugation, induction or inhibition of mating behavior in bacteria and fungi, induction or inhibition of nodule formation or metabolic compartmentalization, metal, ion, or nutrient binding, acquisition or inhibition of metal, ion, or nutrient binding and acquisition, and the like.

These applications of the peptides described herein are intended to be illustrative and not limiting. Using the teaching provided herein, other uses will be recognized by one of skill in the art.

Design and Construction of Chimeric Moieties.

In various embodiments this invention provides chimeric moieties comprising one or more targeting moieties attached to one or more effectors. The targeting moieties are typically selected to preferentially bind to a target microorganism (e.g., bacteria, virus, fungi, yeast, alga, protozoan, etc.), or group of microorganisms (e.g., gram-negative or gram-positive bacteria, particular genus, particular species, etc.) In certain embodiments the targeting moiety comprises one or more of the targeting peptides shown in Table 2, and/or Table 4 and/or Table 6. In certain embodiments the targeting moiety comprises non-peptide moieties (e.g., antibodies, receptor, receptor ligand, lectin, and the like).

The effector typically comprises one or more moieties whose activity is to be delivered to the target microorganism(s), and/or to a biofilm comprising the target microorganism(s), and/or to a cell or tissue comprising the target microorganism(s), and the like. In certain embodiments the targeting moiety comprises one or more antimicrobial peptide(s) as described herein (see, e.g., antimicrobial peptides in Table 2, and/or Table 8, and/or Table 9, and/or Table 10), an antibiotic (including, but not limited to a steroid antibiotic) (see, e.g., Table 7), a detectable label, a porphyrin, a photosensitizing agent, an epitope tag, a lipid or liposome, a nanoparticle, a dendrimer, and the like.

In certain embodiments one or more targeting moieties are attached to a single effector (see, e.g. FIG. 12). In certain embodiments one or more effectors are attached to a single targeting moiety. In certain embodiments multiple targeting moieties are attached to multiple effectors. The targeting moiety(s) can be attached directly to the effector(s) or through a linker. Where the targeting moiety and the effector comprise peptides the chimeric moiety can be a fusion protein.

Targeting Moieties.

In various embodiments this invention provides targeting moieties that preferentially and/or specifically bind to a microorganism (e.g., a bacterium, a fungus, a yeast, etc.). One or more such targeting moieties can be attached to one or more effectors to provide chimeric moieties that are capable of delivering the effector(s) to a target (e.g., a bacterium, a fungus, a yeast, a biofilm comprising the bacterium or fungus or yeast, etc.).

In various embodiments, targeting moieties include, but are not limited to peptides that preferentially bind particular microorganisms (e.g., bacteria, fungi, yeasts, protozoa, algae, viruses, etc.) or groups of such microorganisms, antibodies that bind particular microorganisms or groups of microorganisms, receptor ligands that bind particular microorganisms or groups of microorganisms, porphyrins (e.g., metalloporphyrins), lectins that bind particular microorganisms or groups of microorganisms, and the like. As indicated, it will be appreciated that references to microorganisms or groups of microorganism include bacteria or groups of bacteria, viruses or groups of viruses, yeasts or groups of yeasts, protozoa or groups of protozoa, viruses or groups of viruses, and the like.

Targeting Peptides.

In certain embodiments the chimeric constructs described herein comprise a targeting moiety that is or comprises a targeting peptide. Typically the targeting peptides bind particular bacteria, and/or fungi, and/or yeasts, and/or algae, and/or viruses and/or bind particular groups of bacteria, and/or groups of fungi, and/or groups of yeasts, and/or groups of algae. The targeting peptides provided can be used to effectively deliver one or more effectors to or into a target microorganism. Illustrative targeting peptides include, but are not limited to the targeting peptides found in Table 2.

Other suitable targeting peptides include the peptides that have been identified as binding to particular target organisms as shown in Table 3 and/or Table 4.

TABLE 3

Illustrative list of novel targeting peptides.

| ID | Target(s) | Targeting Peptide Sequence | SEQ ID NO: |
|---|---|---|---|
| 1T-1 | S. mutans | YVNYNQSFNSGW | 67 |
| 1T-2 | S. mutans<br>S. sanguinis<br>S. gordonii<br>S. mitis<br>S. oralis<br>V. atypica<br>Lactobacillus casei<br>Saliva-derived biofilms | NIFEYFLE | 68 |
| 1T-3 | S. mutans<br>S. gordonii | VLGIAGGLDAYGELVGGN | 69 |
| 1T-4 | S. mutans<br>S. gordonii<br>S. sanguinis<br>S. oralis<br>V. atypica<br>L. casei | LDAYGELVGGN | 70 |
| 1T-5 | S. mutans<br>S. sanguinis | LGPIAGAAIGWDLGAISGAGL GWANFCQ | 71 |
| 1T-6 | S. mutans | KFINGVLSQFVLERK | 72 |
| 1T-7 | Myxococcus xanthus | SQRIIEPVKSPQPYPGFSVS | 73 |
| 1T-8 | M. xanthus | FSVAACGEQRAVTFVLLIEDLI | 74 |
| 1T-9 | M. xanthus | WAWAESPRCVSTRSNIHALAF RVEVAALT | 75 |
| 1T-10 | M. xanthus | SPAGLPGDGDEA | 76 |
| 1T-11 | S. mutans<br>S. epidermidis<br>P. aeruginosa | RISE | 77 |
| 1T-12 | Corynebacterium xerosis<br>Corynebacterium striatum<br>S. epidermidis<br>S. mutans | FGNIFKGLKDVIETIVKWTAAK | 78 |
| 1T-13 | S. aureus<br>S. epidermidis<br>P. aeruginosa | FRSPCINNNSLQPPGVYPAR | 79 |
| 1T-14 | S. mutans<br>S. aureus<br>S. epidermidis<br>C. xerosis | ALAGLAGLISGK | 80 |
| 1T-15 | S. mutans | DVILRVEAQ | 81 |
| 1T-16 | P. aeruginosa | IDMR | 82 |
| 1T-17 | S. mutans | NNAIVYIS | 83 |

TABLE 3-continued

Illustrative list of novel targeting peptides.

| ID | Target(s) | Targeting Peptide Sequence | SEQ ID NO: |
|---|---|---|---|
| 1T-18 | S. aureus<br>S. epidermidis<br>C. striatum<br>P. aeruginosa | YSKTLHFAD | 84 |
| 1T-19 | S. aureus<br>S. epidermidis<br>P. aeruginosa | PGAFRNPQMPRG | 85 |
| 1T-20 | S. mutans<br>P. aeruginosa | PALVDLSNKEAVWAVLDDHS | 86 |
| 1T-21 | S. mutans<br>P. aeruginosa | YVEEAVRAALKKEARISTEDTPVNLPSFDC | 87 |
| 1T-22 | S. epidermidis<br>P. aeruginosa | VPLDDGTRRPEVARNRDKDRED | 88 |
| 1T-23 | S. mutans<br>P. aeruginosa | PALVDLSNKEAVWAVLDDHS | 89 |
| 1T-24 | P. aeruginosa | EEAEEKLAEVSQAVKRLVR | 90 |
| 1T-25 | S. aureus<br>S. epidermidis<br>C. xerosis<br>C. striatum<br>P. aeruginosa | VGLDVSVLVLFFGLQLLSVLLGAMIR | 91 |
| 1T-26 | S. mutans<br>S. aureus<br>S. epidermidis<br>Corynebacterium jeikeium<br>C. xerosis<br>C. striatum<br>P. aeruginosa | LTILPTTFFAIIVPILAVAFIAYSGFKIKGIVEHKDQW | 92 |
| 1T-27 | S. mutans<br>S. aureus<br>S. epidermidis<br>C. jeikeium<br>C. xerosis<br>C. striatum<br>P. aeruginosa | ALFVSLEQFLVVVAKSVFALCHSGTLS | 93 |
| 1T-28 | P. aeruginosa | VSRDEAMEFIDREWTTLQPAGKSHA | 94 |
| 1T-29 | S. mutans<br>S. aureus<br>S. epidermidis<br>C. jeikeium<br>C. xerosis<br>C. striatum<br>P. aeruginosa | GSVIKKRRKRMSKKKHRKMLRRTRVQRRKLGK | 95 |
| 1T-30 | S. aureus<br>S. epidermidis<br>C. xerosis<br>C. striatum<br>P. aeruginosa | GKAKPYQVRQVLRAVDKLETRRKKGGR | 96 |
| 1T-31 | S. mutans<br>P. aeruginosa | NATGTDIGEVTLTLGRFS | 97 |
| 1T-32 | S. mutans | VSFLAGWLCLGLAAWRLGNA | 98 |
| 1T-33 | S. aureus<br>S. epidermidis<br>C. jeikeium<br>C. xerosis<br>C. striatum<br>P. aeruginosa | VRTLTILVIFIFNYLKSISYKLKQPFENNLAQSMISI | 99 |

TABLE 3-continued

Illustrative list of novel targeting peptides.

| ID | Target(s) | Targeting Peptide Sequence | SEQ ID NO: |
|---|---|---|---|
| 1T-34 | S. aureus<br>S. epidermidis<br>C. jeikeium<br>C. xerosis<br>C. striatum<br>P. aeruginosa | AFWLNILLTLLGYIPGIVHAVYI<br>IAKR | 100 |
| 1T-35 | P. aeruginosa | EICLTLVFPIRGSYSEAAKFPVPI<br>HIVEDGTVELPK | 101 |
| 1T-36 | S. aureus<br>S. epidermidis<br>C. jeikeium<br>C. xerosis<br>C. striatum<br>P. aeruginosa | VYRHLRFIDGKLVEIRLERK | 102 |
| 1T-37 | S. mutans<br>S. aereus<br>S. epidermidis<br>C. jeikeium<br>C. xerosis<br>C. striatum<br>P. aeruginosa | YIVGALVILAVAGLIYSMLRKA | 103 |
| 1T-38 | S. mutans<br>S. aereus<br>S. epidermidis<br>C. jeikeium<br>C. xerosis<br>C. striatum<br>P. aeruginosa | VMFVLTRGRSPRPMIPAY | 104 |
| 1T-39 | S. mutans<br>P. aeruginosa | FGFCVWMYQLLAGPPGPPA | 105 |
| 1T-40 | S. mutans<br>P. aeruginosa | QRVSLWSEVEHEFR | 106 |
| 1T-41 | S. mutans<br>S. aureus<br>S. epidermidis<br>C. jeikeium<br>C. striatum<br>P. aeruginosa | KRGSKIVIAIAVVLIVLAGVWVW | 107 |
| 1T-42 | S. aureus<br>S. epidermidis<br>C. xerosis<br>C. striatum<br>P. aeruginosa | TVLDWLSLALATGLFVYLLVA<br>LLRADRA | 108 |
| 1T-43 | C. jeikium<br>P. aeruginosa | DRCLSVLSWSPPKVSPLI | 109 |
| 1T-44 | S. mutans<br>S. aureus<br>S. epidermidis<br>C. jeikeium<br>C. striatum<br>P. aeruginosa | DPALADFAAGMRAQVRT | 110 |
| 1T-45 | S. aureus<br>S. epidermidis<br>C. striatum<br>P. aeruginosa | WTKPSFTDLRLGFEVTLYFANR | 111 |
| 1T-46 | S. aureus<br>S. epidermidis<br>C. jeikeium<br>C. xerosis<br>C. striatum<br>P. aeruginosa | FSFKQRVMFRKEVERLR | 112 |

TABLE 3-continued

Illustrative list of novel targeting peptides.

| ID | Target(s) | Targeting Peptide Sequence | SEQ ID NO: |
|---|---|---|---|
| 1T-47 | S. mutans<br>S. epidermidis<br>P. aeruginosa | VIKISVPGQVQMLIP | 113 |
| 1T-48 | S. aureus<br>S. epidermidis<br>C. jeikeium<br>C. xerosis<br>C. striatum<br>P. aeruginosa | KLQVHHGRATHTLLLQPPLCAPGTIR | 114 |
| 1T-49 | S. aureus<br>S. epidermidis<br>C. jeikeium<br>P. aeruginosa | SLVRIHDQQPWVTRGAFIDAARTCS | 115 |
| 1T-50 | P. aeruginosa | HSDEPIPNILFKSDSVH | 116 |
| 1T-51 | S. aureus<br>P. aeruginosa | GKPKRMPAEFIDGYGQALLAGA | 117 |
| 1T-52 | S. aureus<br>C. xerosis<br>P. aeruginosa | DEYPAKLPLSDKGATEPRRH | 118 |
| 1T-53 | P. aeruginosa | SDILAEMFEKGELQTLVKDAAAKANA | 119 |
| 1T-54 | S. epidermidis<br>C. xerosis<br>C. striatum<br>P. aeruginosa | RWVSCNPSWRIQ | 120 |
| 1T-55 | C. xerosis<br>P. aeruginosa | NHKTLKEWKAKWGPEAVESWATLLG | 121 |
| 1T-56 | C. xerosis<br>P. aeruginosa | LALIGAGIWMIRKG | 122 |
| 1T-57 | P. aeruginosa | RLEYRRLETQVEENPESGRRPMRG | 123 |
| 1T-58 | P. aeruginosa | CDDLHALERAGKLDALLSA | 124 |
| 1T-59 | S. aureus<br>S. epidermidis<br>P. aeruginosa | AVGNNLGKDNDSGHRGKKHRKHKHR | 125 |
| 1T-60 | S. aureus<br>S. epidermidis<br>C. jeikeium<br>C. striatum<br>P. aeruginosa | YLTSLGLDAAEQAQGLLTILKG | 126 |
| 1T-61 | P. aeruginosa | HATLLPAVREAISRQLLPALVPRG | 127 |
| 1T-62 | S. epidermidis<br>P. aeruginosa | GCKGCAQRDPCAEPEPYFRLR | 128 |
| 1T-63 | S. aureus<br>S. epidermidis<br>C. jeikeium<br>C. xerosis<br>C. striatum<br>P. aeruginosa | EPLILKELVRNLFLFCYARALR | 129 |
| 1T-64 | S. aureus<br>S. epidermidis<br>C. jeikeium<br>C. xerosis<br>C. striatum<br>P. aeruginosa | QTVHHIHMHVLGQRQMHWPPG | 130 |

TABLE 3-continued

Illustrative list of novel targeting peptides.

| ID | Target(s) | Targeting Peptide Sequence | SEQ ID NO: |
|---|---|---|---|
| 1T-65 | S. mutans<br>S. aureus<br>S. epidermidis<br>C. jeikeium<br>C. xerosis<br>C. striatum<br>P. aeruginosa | HARAAVGVAELPRGAAVEVEL IAAVRP | 131 |
| 1T-66 | S. mutans<br>S. aureus<br>S. epidermidis<br>C. jeikeium<br>C. xerosis<br>C. striatum<br>P. aeruginosa | DTDCLSRAYAQRIDELDKQYA GIDKPL | 132 |
| 1T-67 | S. aureus<br>S. epidermidis<br>C. jeikeium<br>C. xerosis<br>C. striatum<br>P. aeruginosa | GQRQRLTCGRVSGCSEGPSREA AR | 133 |
| 1T-68 | S. mutans<br>S. aureus<br>C. jeikeium<br>C. xerosis<br>C. striatum<br>P. aeruginosa | GGTKEIVYQRG | 134 |
| 1T-69 | S. mutans<br>P. aeruginosa | ILSQEADRKKLF | 135 |
| 1T-70 | S. aureus<br>C. jeikeium<br>P. aeruginosa | NRQAQGERAHGEQQG | 136 |
| 1T-71 | P. aeruginosa | KIDTNQWPPNKEG | 137 |
| 1T-72 | P. aeruginosa | EPTDGVACKER | 138 |
| 1T-73 | Streptococcus pneumoniae | GWWEELLHETILSKFKITKALE LPIQL | 139 |
| 1T-74 | S. pneumoniae | DIDWGRKISCAAGVAYGAIDG CATTV | 140 |
| 1T-75 | S. pneumoniae | GVARGLQLGIKTRTQWGAATG AA | 141 |
| 1T-76 | S. pneumoniae | EMRLSKFFRDFILWRKK | 142 |
| 1T-77 | S. pneumoniae | EMRISRIILDFLFLRKK | 143 |
| 1T-78 | S. pneumoniae | FFKTIFVLILGALGVAAGLYIEK NYIDK | 144 |
| 1T-79 | S. pneumoniae | FGTPWSITNFWKKNFNDRPDF DSDRRRY | 145 |
| 1T-80 | S. pneumoniae | GGNLGPGFGVIIP | 146 |
| 1T-81 | S. pneumoniae | AIATGLDIVDGKFDGYLWA | 147 |
| 1T-82 | S. pneumoniae | FGVGVGIALFMAGYAIGKDLR KKFGKSC | 148 |
| 1T-83 | S. pneumoniae | QKPRKNETFIGYIQRYDIDGNG YQSLPCPQN | 149 |
| 1T-84 | S. pneumoniae | FRKKRYGLSILLWLNAFTNLVN SIHAFYMTLF | 150 |

TABLE 3-continued

Illustrative list of novel targeting peptides.

| ID | Target(s) | Targeting Peptide Sequence | SEQ ID NO: |
|---|---|---|---|
| 1T-85 | A. naeslundii, F. nucleatum, P. gingivalis S. epidermidis, S. gordonii, S. mitis, S. mutans, S. oralis, S. salivarious, S. sanguinis | VMASLTWRMRAASASLPTHSR TDA | 151 |
| 1T-86 | S. mitis, S. oralis, S. salivarious | HRKNPVLGVGRRHRAHNVA | 152 |
| 1T-87 | S. mitis, S. mutans, S. oralis | EAVGQDLVDAHHP | 153 |
| 1T-88 | Unanalyzed | GRLVLEITADEVKALGEALAN AKI | 154 |
| 1T-89 | S. mitis, S. mutans | HEDDKRRGMSVEVLGFEVVQH EE | 155 |
| 1T-90 | S. gordonii, S. mitis, S. mutans, S. oralis, S. sanguinis | RNVIGQVL | 156 |
| 1T-91 | S. mitis, S. mutans, S. oralis, S. sanguinis | TSVRPGAAGAAVPAGAAGAA GAGWRWP | 157 |
| 1T-92 | S. mitis, S. mutans | GQDEGQRRAGVGEGQGVDG | 158 |
| 1T-93 | S. epidermidis, S. gordonii, S. mitis, S. mutans, S. oralis, S. sanguinis | AMRSVNQA | 159 |
| 1T-94 | S. mitis, S. mutans, S. oralis | DQVAHSGDMLVQARRRDS | 160 |
| 1T-95 | S. gordonii, S. mitis, S. mutans, S. oralis, S. sanguinis | GHLLRVGGRVGGVGGVAGAC AQPFGGQ | 161 |
| 1T-96 | S. gordonii, S. mitis, S. mutans, S. oralis, S. sanguinis | VAGACAQPFGGQ | 162 |
| 1T-97 | A. naeslundii, F. nucleatum, P. gingivalis S. epidermidis, S. gordonii, S. mitis, S. mutans, S. oralis, S. salivarious, S. sanguinis | GVAERNLDRITVAVAIIWTITIV GLGLVAKLG | 163 |
| 1T-98 | A. naeslundii, F. nucleatum, P. gingivalis S. epidermidis, S. gordonii, S. mitis, S. mutans, S. oralis, S. salivarious, S. sanguinis | VRSAKAVKALTAAGYTGELVN VSGGMKAWLGQ | 164 |
| 1T-99 | S. gordonii, S. mitis, S. mutans, S. oralis, S. sanguinis | MKAWLGQ | 165 |
| 1T-100 | S. gordonii, S. mitis, S. mutans | LDPLEPRIAPPGDRSHQGAPAC HRDPLRGRSARDAER | 166 |
| 1T-101 | A. naeslundii, P. gingivalis S. epidermidis, S. gordonii, S. mitis, S. mutans, S. oralis, S. sanguinis | RLRVGRATDLPLTSFAVGVVR NLPDAPAH | 167 |
| 1T-102 | A. naeslundii, F. nucleatum, P. gingivalis S. epidermidis, S. gordonii, S. mitis, S. mutans, S. oralis, S. salivarious, S. sanguinis | WKRLWPARILAGHSRRRMRW MVVWRYFAAT | 168 |
| 1T-103 | A. naeslundii, F. nucleatum, P. gingivalis S. epidermidis, S. gordonii, S. mitis, S. mutans, S. oralis, S. sanguinis | AQFYEAIITGYALGAGQRIGQL | 169 |

TABLE 3-continued

Illustrative list of novel targeting peptides.

| ID | Target(s) | Targeting Peptide Sequence | SEQ ID NO: |
|---|---|---|---|
| 1T-104 | S. mitis | RAVAAHLQGRHHGHQVRRQRHGQR | 170 |
| 1T-105 | S. epidermidis, S. gordonii, S. mitis, S. mutans, S. oralis | GEGLPPPVLHLPPPRMSGR | 171 |
| 1T-106 | S. gordonii, S. mitis, S. mutans, S. oralis, S. salivarious | DALRRSRSQGRRHR | 172 |
| 1T-107 | A. naeslundiiS. epidermidis, S. gordonii, S. mitis, S. mutans, S. oralis, S. salivarious, S. sanguinis | SPVPRFTAVGGVSRGSP | 173 |
| 1T-108 | S. gordonii, S. mitis, S. mutans, S. oralis, S. salivarious, S. sanguinis | WGPLGPERPLW | 174 |
| 1T-109 | A. naeslundiiS. epidermidis, S. gordonii, S. mitis, S. mutans, S. oralis, S. salivarious, S. sanguinis | VTTNVRQGAGS | 175 |
| 1T-110 | A. naeslundii, P. gingivalis S. epidermidis, S. gordonii, S. mitis, S. mutans, S. oralis, S. sanguinis | LAAKTAVCVGRAFM | 176 |
| 1T-111 | A. naeslundii, F. nucleatum, P. gingivalis S. epidermidis, S. gordonii, S. mitis, S. mutans, S. oralis, S. salivarious, S. sanguinis | GRLSRREEDPATSIILLRGAYRMAVF | 177 |
| 1T-112 | S. gordonii | SDNDGKLILGTSQ | 178 |
| 1T-113 | S. mitis | HGAHQRTGQRLHHHRGRTVSGCRQNPVAGVDPDEHR | 179 |
| 1T-114 | A. naeslundii, P. gingivalis S. epidermidis, S. gordonii, S. mitis, S. mutans, S. oralis, S. sanguinis | RQAPGPGLVTITAACSAPGSRSR | 180 |
| 1T-115 | A. naeslundii, F. nucleatum, P. gingivalis S. epidermidis, S. gordonii, S. mitis, S. mutans, S. oralis, S. salivarious, S. sanguinis | LLIERFSNHH | 181 |
| 1T-116 | A. naeslundii, P. gingivalis S. epidermidis, S. gordonii, S. mitis, S. mutans, S. oralis, S. salivarious, S. sanguinis | MILHRRRDR | 182 |
| 1T-117 | S. mutans | GPGVVGPAPFSRLPAHALNL | 183 |
| 1T-118 | A. naeslundii, F. nucleatum, P. gingivalis S. epidermidis, S. gordonii, S. mitis, S. mutans, S. oralis, S. salivarious, S. sanguinis | TASPPAPSDQGLRTAFPATLLIALAALARISR | 184 |
| 1T-119 | S. gordonii, S. mitis, S. mutans, S. oralis | SPATQKAPTRAQPSRAPVQDCGDGRPTAAPDDVERLSPR | 185 |
| 1T-120 | A. naeslundii, F. nucleatum, P. gingivalis S. epidermidis, | DVRDRVDLAGADLCAAHATR | 186 |

TABLE 3-continued

Illustrative list of novel targeting peptides.

| ID | Target(s) | Targeting Peptide Sequence | SEQ ID NO: |
|---|---|---|---|
| | S. gordonii, S. mitis, S. mutans, S. oralis, S. salivarious, S. sanguinis | | |
| 1T-121 | S. gordonii, S. mitis, S. mutans, S. oralis, S. salivarious, S. sanguinis | FAKETGFGIGGAQEGWWIIADIYGPNPF | 187 |
| 1T-122 | S. mitis | GAIPDPVTHRVDWEEDHQTRPSR | 188 |
| 1T-123 | S. gordonii | LVRRNAVAGRSDGLAGAEQLDLVRLQGVL | 189 |
| 1T-124 | S. mitis, S. mutans, S. oralis | LFDERNKIA | 190 |
| 1T-125 | S. epidermidis, S. gordonii, S. mutans, S. oralis | DAITGGNPPLSDTDGLRP | 191 |
| 1T-126 | S. gordonii, S. mitis, S. mutans | QGLARPVLRRIPL | 192 |
| 1T-127 | A. naeslundii, F. nucleatum, P. gingivalis, T. denticola S. gordonii, S. mitis, S. mutans, S. oralis, S. salivarious, S. sanguinis | YDPVPKRKNKNSEGKREE | 193 |
| 1T-128 | A. naeslundii, P. gingivalis S. epidermidis, S. gordonii, S. mitis, S. mutans, S. oralis, S. salivarious, S. sanguinis | SGSAIRMLEIATKMLKR | 194 |
| 1T-129 | A. naeslundii, P. gingivalis S. epidermidis, S. gordonii, S. mitis, S. mutans, S. oralis, S. salivarious, S. sanguinis | YDKYIKYLSIQPPFIVYFI | 195 |
| 1T-130 | A. naeslundii, F. nucleatum, P. gingivalis S. epidermidis, S. gordonii, S. mitis, S. mutans, S. oralis, S. salivarious, S. sanguinis | QKIIDMSKFLFSLILFIMIVVIYIGKSIGGYSAIVSSIMLELDTVLYNKKIFFIYK | 196 |
| 1T-131 | A. naeslundii, F. nucleatum, P. gingivalis, T. denticola S. gordonii, S. mitis, S. mutans, S. oralis, S. salivarious, S. sanguinis | DEVWKMLGI | 197 |
| 1T-132 | A. naeslundii, F. nucleatum, P. gingivalis S. epidermidis, S. gordonii, S. mitis, S. mutans, S. oralis, S. salivarious, S. sanguinis | YSKKLFEYFYFIIFILIRYLIFYKIIQNKNYYINNIAYN | 198 |
| 1T-133 | A. naeslundii, P. gingivalis S. epidermidis, S. gordonii, S. mitis, S. mutans, S. oralis, S. salivarious, S. sanguinis | YFIKDDNEALSKDWEVIGNDLKGTIDKYGKEFKVR | 199 |
| 1T-134 | A. naeslundii, F. nucleatum, P. gingivalis S. epidermidis, S. gordonii, S. mitis, S. mutans, S. oralis, S. salivarious, S. sanguinis | SRLVREIKKKCRKS | 200 |
| 1T-135 | A. naeslundii, P. gingivalis S. epidermidis, S. gordonii, S. mitis, S. mutans, | FESLLPQATKKIVNNKGSKINKIF | 201 |

TABLE 3-continued

Illustrative list of novel targeting peptides.

| ID | Target(s) | Targeting Peptide Sequence | SEQ ID NO: |
|---|---|---|---|
| | S. oralis, S. salivarious, S. sanguinis | | |
| 1T-136 | A. naeslundii, F. nucleatum, P. gingivalis, S. epidermidis, S. gordonii, S. mitis, S. mutans, S. oralis, S. salivarious, S. sanguinis | ELLTQIRLALLYSVNEW | 202 |
| 1T-137 | A. naeslundii, F. nucleatum, P. gingivalis S. epidermidis, S. gordonii, S. mitis, S. mutans, S. oralis, S. salivarious, S. sanguinis | PLNFYRAVKENRLPLSEKNIND FTNIKLKVSPKLINLLQESSIFY NFSPKKRNTN | 203 |
| 1T-138 | A. naeslundii, F. nucleatum, P. gingivalis S. epidermidis, S. gordonii, S. mitis, S. mutans, S. oralis, S. salivarious, S. sanguinis | YPNEYCIFLENLSLEELKEIKAI NGETLNLEEIINERKNLKD | 204 |
| 1T-139 | A. naeslundiiS. gordonii, S. mitis, S. mutans, S. oralis | AVAGAAVGALLGNDARSTAV GAAIGGALGAGAGELTKNK | 205 |
| 1T-140 | A. naeslundii, F. nucleatum, P. gingivalis S. epidermidis, S. gordonii, S. mitis, S. mutans, S. oralis, S. salivarious, S. sanguinis | IKGTIAFVGEDYVEIRVDKGVK LTFRKSAIANVINNNQQ | 206 |
| 1T-141 | F. nucleatum, P. gingivalis S. epidermidis, S. gordonii, S. mitis, S. mutans, S. oralis, S. sanguinis | KKFIILLFILVQGLIFSATKTLSD IIAL | 207 |
| 1T-142 | A. naeslundii, F. nucleatum, P. gingivalis, T. denticolaS. gordonii, S. mitis, S. mutans, S. oralis, S. salivarious, S. sanguinis | FTQGIKRIVLKRLKED | 208 |
| 1T-143 | A. naeslundii, F. nucleatum, P. gingivalis S. epidermidis, S. gordonii, S. mitis, S. mutans, S. oralis, S. salivarious, S. sanguinis | MPKRHYYKLEAKALQFGLPFA YSPIQLLK | 209 |
| 1T-144 | A. naeslundii, F. nucleatum, P. gingivalis, T. denticolaS. gordonii, S. mitis, S. mutans, S. oralis, S. salivarious, S. sanguinis | IIELHPKSWTQDWRCSFL | 210 |
| 1T-145 | S. mitis, S. mutans, S. oralis | VEAGKRNISLENIEKISKGLGISI SELFKYIEEGEDKIG | 211 |
| 1T-146 | A. naeslundii, F. nucleatum, P. gingivalis, T. denticolaS. gordonii, S. mitis, S. mutans, S. oralis, S. salivarious, S. sanguinis | RNSADNQTKIDKIRIDISLWDE HLNIVKQGK | 212 |
| 1T-147 | A. naeslundii, F. nucleatum, P. gingivalis, T. denticolaS. gordonii, S. mitis, S. mutans, S. oralis, S. salivarious, S. sanguinis | GVENRRFYERDVSKVSMMTSE AVAPRGGSK | 213 |
| 1T-148 | A. naeslundii, F. nucleatum, P. gingivalis, | IVELDDTTILERALSMLGEANA | 214 |

TABLE 3-continued

Illustrative list of novel targeting peptides.

| ID | Target(s) | Targeting Peptide Sequence | SEQ ID NO: |
|---|---|---|---|
| | T. denticola S. gordonii, S. mitis, S. mutans, S. oralis, S. salivarious, S. sanguinis | | |
| 1T-149 | A. naeslundii, F. nucleatum, P. gingivalis, T. denticola S. gordonii, S. mitis, S. mutans, S. oralis, S. salivarious, S. sanguinis | SVRAVKPIDETVARHFPGDFIVN | 215 |
| 1T-150 | A. naeslundii, F. nucleatum, P. gingivalis, T. denticola S. gordonii, S. mitis, S. mutans, S. oralis, S. salivarious, S. sanguinis | YINRRLKKAFSDADIKEAPAEFYEELRRVQYV | 216 |
| 1T-151 | A. naeslundii, F. nucleatum, P. gingivalis, T. denticola S. gordonii, S. mitis, S. mutans, S. oralis, S. salivarious, S. sanguinis | SVRAVKPIDEIVAWHFPGDFIVN | 217 |
| 1T-152 | A. naeslundii, F. nucleatum, P. gingivalis S. epidermidis, S. gordonii, S. mitis, S. mutans, S. oralis, S. salivarious, S. sanguinis | YVSADESAYNHIVTDDIPLADRRIEAVQQ | 218 |
| 1T-153 | A. naeslundii, F. nucleatum, P. gingivalis S. epidermidis, S. gordonii, S. mitis, S. mutans, S. oralis, S. salivarious, S. sanguinis | YIACPGYFY | 219 |
| 1T-154 | P. gingivalis | YFSFLEIVGMARR | 220 |
| 1T-155 | A. naeslundii, F. nucleatum, P. gingivalis S. epidermidis, S. gordonii, S. mitis, S. mutans, S. oralis, S. salivarious, S. sanguinis | LKLAFGVYPFQAMSQSDTAVSERNVLWR | 221 |
| 1T-156 | A. naeslundii, F. nucleatum, P. gingivalis, T. denticola S. gordonii, S. mitis, S. mutans, S. oralis, S. salivarious, S. sanguinis | GRFQISIRGEEKSKVKVQGKGTFTDRNTT | 222 |
| 1T-157 | A. naeslundii, F. nucleatum, P. gingivalis, T. denticola S. gordonii, S. mitis, S. mutans, S. oralis, S. salivarious, S. sanguinis | RRFRKTTENREKSKNKKAVLGLSTTSTASY | 223 |
| 1T-158 | A. naeslundii, F. nucleatum, P. gingivalis S. epidermidis, S. gordonii, S. mitis, S. mutans, S. oralis, S. salivarious, S. sanguinis | WENKPSPLGSIKKLQGLVYRLIGYRHFWV | 224 |
| 1T-159 | P. gingivalis | IFSLHHFALICSEMGTFAVSKRAKYKWEVL | 225 |
| 1T-160 | A. naeslundii, F. nucleatum, P. gingivalis, T. denticola S. gordonii, S. mitis, S. mutans, S. oralis, S. salivarious, S. sanguinis | AQYKYINKLLN | 226 |
| 1T-161 | A. naeslundii, F. nucleatum, P. gingivalis | NKVLQVEVMWDGSVVGRPAGVISIKSSKKG | 227 |

TABLE 3-continued

Illustrative list of novel targeting peptides.

| ID | Target(s) | Targeting Peptide Sequence | SEQ ID NO: |
|---|---|---|---|
| | S. epidermidis, S. gordonii, S. mitis, S. mutans, S. oralis, S. salivarious, S. sanguinis | | |
| 1T-162 | A. naeslundii, F. nucleatum, P. gingivalis, T. denticolaS. gordonii, S. mitis, S. mutans, S. oralis, S. salivarious, S. sanguinis | QKAKEESDRKAAVSYNGFHRV NVVSIPK | 228 |
| 1T-163 | A. naeslundii, F. nucleatum, P. gingivalis S. epidermidis, S. gordonii, S. mitis, S. mutans, S. oralis, S. salivarious, S. sanguinis | MENILIYIPMVLSPFGSGILLFLG KDRRYML | 229 |
| 1T-164 | A. naeslundii, F. nucleatum, P. gingivalis S. epidermidis, S. gordonii, S. mitis, S. mutans, S. oralis, S. salivarious, S. sanguinis | KKSHSQGKRKLKDLNSAYKID NQLHYALR | 230 |
| 1T-165 | A. naeslundii, F. nucleatum, P. gingivalis S. epidermidis, S. gordonii, S. mitis, S. mutans, S. oralis, S. salivarious, S. sanguinis | CYDSFDFSIFVTFANRMKLSVGS | 231 |
| 1T-166 | A. naeslundii, F. nucleatum, P. gingivalis S. epidermidis, S. gordonii, S. mitis, S. mutans, S. oralis, S. salivarious, S. sanguinis | AQSAGQIKRKSKVRIHV | 232 |
| 1T-167 | A. naeslundii, F. nucleatum, P. gingivalis S. epidermidis, S. gordonii, S. mitis, S. mutans, S. oralis, S. salivarious, S. sanguinis | SRMSEHSPAGLVFEVGPMDKG SFIILDSYHPTVKK | 233 |
| 1T-168 | A. naeslundii, F. nucleatum, P. gingivalis S. epidermidis, S. gordonii, S. mitis, S. mutans, S. oralis, S. salivarious, S. sanguinis | ELHRIMSTEKIGAVTKMNFDTA PIMSILPIDIYPKEVGIGS | 234 |
| 1T-169 | A. naeslundii, F. nucleatum, P. gingivalis S. epidermidis, S. gordonii, S. mitis, S. mutans, S. oralis, S. salivarious, S. sanguinis | FARVRRLHQNRILTQPLTNLKY CLRQPIYSD | 235 |
| 1T-170 | P. gingivalis | AYGKVFSMDIMLSENDKLIVLR ISHHSAWH | 236 |
| 1T-171 | A. naeslundii, F. nucleatum, P. gingivalis S. epidermidis, S. gordonii, S. mitis, S. mutans, S. oralis, S. salivarious, S. sanguinis | SVRAVKPIDKTVARHFPGDFIVN | 237 |
| 1T-172 | A. naeslundii, F. nucleatum, P. gingivalis S. epidermidis, S. gordonii, S. mitis, S. mutans, | FEGLKNLLGDDII | 238 |

TABLE 3-continued

Illustrative list of novel targeting peptides.

| ID | Target(s) | Targeting Peptide Sequence | SEQ ID NO: |
|---|---|---|---|
| | S. oralis, S. salivarious, S. sanguinis | | |
| 1T-173 | A. naeslundii, F. nucleatum, P. gingivalis S. gordonii, S. mitis, S. mutans, S. oralis, S. salivarious, S. sanguinis | LFRKEDQEHVLL | 239 |
| 1T-174 | A. naeslundii, F. nucleatum, P. gingivalis, T. denticola S. gordonii, S. mitis, S. mutans, S. oralis, S. salivarious, S. sanguinis | SGGSDTDGSSSGEPGSHSGDL | 240 |
| 1T-175 | A. naeslundii, F. nucleatum, P. gingivalis, S. epidermidis, S. gordonii, S. mitis, S. mutans, S. oralis, S. salivarious, S. sanguinis | GEPGSHSGDL | 241 |
| 1T-176 | A. naeslundii, P. gingivalis S. epidermidis, S. gordonii, S. mitis, S. mutans, S. oralis, S. salivarious, S. sanguinis | PVGDIMSGFLRGANQPRFLLDH ISFGS | 242 |
| 1T-177 | P. gingivalis S. gordonii, S. mitis, S. mutans, S. oralis, S. salivarious, S. sanguinis | GTNVPTQILGYSREERFDYEPA PEQR | 243 |
| 1T-178 | A. naeslundii, F. nucleatum, P. gingivalis S. epidermidis, S. gordonii, S. mitis, S. mutans, S. oralis, S. salivarious, S. sanguinis | LLASHPERLSLGVFFVYRVLHL LLENT | 244 |
| 1T-179 | A. naeslundii, F. nucleatum, P. gingivalis, T. denticola S. gordonii, S. mitis, S. mutans, S. oralis, S. salivarious, S. sanguinis | TCYPLIQRKTDRAYEA | 245 |
| 1T-180 | A. naeslundii, F. nucleatum, P. gingivalis, T. denticola S. gordonii, S. mitis, S. mutans, S. oralis, S. salivarious, S. sanguinis | VVFGGGDRLV | 246 |
| 1T-181 | A. naeslundii, F. nucleatum, P. gingivalis, T. denticola S. gordonii, S. mitis, S. mutans, S. oralis, S. salivarious, S. sanguinis | YGKESDP | 247 |
| 1T-182 | A. naeslundii, F. nucleatum, P. gingivalis, T. denticola S. gordonii, S. mitis, S. mutans, S. oralis, S. salivarious, S. sanguinis | LTASICRQWNDNSTPYQR | 248 |
| 1T-183 | A. naeslundii, F. nucleatum, P. gingivalis S. epidermidis, S. gordonii, S. mitis, S. mutans, S. oralis, S. salivarious, S. sanguinis | PLRSFVAEKAEHAFRVVRIADF DFGHS | 249 |
| 1T-184 | A. naeslundii, F. nucleatum, P. gingivalis, T. denticola S. gordonii, S. mitis, S. mutans, S. oralis, S. salivarious, S. sanguinis | ALLVLNLLLMQFFFGKNM | 250 |

TABLE 3-continued

Illustrative list of novel targeting peptides.

| ID | Target(s) | Targeting Peptide Sequence | SEQ ID NO: |
|---|---|---|---|
| 1T-185 | A. naeslundii, F. nucleatum, P. gingivalis, T. denticolaS. gordonii, S. mitis, S. mutans, S. oralis, S. salivarious, S. sanguinis | HYHFLLEFGFHKGDYLE | 251 |
| 1T-186 | S. sanguinis | LAKKNQALREEISRQKSK | 252 |
| 1T-187 | S. sanguinis | RAGRIKKLSQKEAEPFEN | 253 |
| 1T-188 | S. sanguinis | HRKDVYKK | 254 |
| 1T-189 | F. nucleatum, S. sanguinis | FIRSKLRRVDFSGVRRGNKHFL LDKLLITLVK | 255 |
| 1T-190 | A. naeslundii, F. nucleatum, P. gingivalisS. epidermidis, S. gordonii, S. mitis, S. mutans, S. oralis, S. salivarious, S. sanguinis | IQIIVNAFVEKDKTGAVIEVLYA SNNHEKVKAKYEELVAIS | 256 |
| 1T-191 | F. nucleatum, S. sanguinis | SALFYDTLAAIWISIAGVDARW GH | 257 |
| 1T-192 | S. sanguinis | ILVLLALQVELDSKFQY | 258 |
| 1T-193 | S. sanguinis | LMIFDKHANLKYKYGNRSFGV EAIM | 259 |
| 1T-194 | F. nucleatum, S. sanguinis | LAGATLVTPYCVGWGLIRSH | 260 |
| 1T-195 | Unanalyzed | AASGFTYCASNGVWHPY | 261 |
| 1T-196 | F. nucleatum, S. sanguinis | KPEKEKLDTNTLMKVVNKALS LFDRLLIKFGA | 262 |
| 1T-197 | A. naeslundii, F. nucleatum, P. gingivalisS. epidermidis, S. gordonii, S. mitis, S. mutans, S. oralis, S. salivarious, S. sanguinis | TEILNFLITVCADRENWKIKHG LSDSVLLIFFARFTGAEYW | 263 |
| 1T-198 | P. gingivalisS. epidermidis, S. gordonii, S. mitis, S. mutans, S. oralis, S. sanguinis | MPVSKKRYMLSSAYATALGIC YGQVATDEKESEITAIPDLLDY LSVEEYLL | 264 |
| 1T-199 | S. sanguinis | RAGRIKKLSQKEAEPFEN | 265 |
| 1T-200 | A. naeslundii, F. nucleatumS. epidermidis, S. gordonii, S. mitis, S. mutans, S. oralis, S. salivarious, S. sanguinis | MRFKRFDRDYALSGDNVFEVL TASCDVIERNLSYREMCGLMQ | 266 |
| 1T-201 | S. sanguinis | KRKHENVIVAEEMRVIKN | 267 |
| 1T-202 | A. naeslundii, F. nucleatum, P. gingivalisS. epidermidis, S. gordonii, S. mitis, S. mutans, S. oralis, S. salivarious, S. sanguinis | LCRLEKLCKQFLRQDKVVTYY LMLPYKRAIEAFYQELKERS | 268 |
| 1T-203 | A. naeslundii, F. nucleatum, P. gingivalisS. epidermidis, S. gordonii, S. mitis, S. mutans, S. oralis, S. salivarious, S. sanguinis | YPFCLATVDHLPEGLSVTDYER VQRLVSQFLLNKEER | 269 |
| 1T-204 | F. nucleatum, S. sanguinis | KYLFLASKTKEYFKSHFREIMI DV | 270 |

TABLE 3-continued

Illustrative list of novel targeting peptides.

| ID | Target(s) | Targeting Peptide Sequence | SEQ ID NO: |
|---|---|---|---|
| 1T-205 | A. naeslundii, F. nucleatum, P. gingivalis S. epidermidis, S. gordonii, S. mitis, S. mutans, S. oralis, S. salivarious, S. sanguinis | FISFVDCIQNIEKIEKELLKIGIT DIQINQDAGWLY | 271 |
| 1T-206 | S. sanguinis | AGFAAGYSL | 272 |
| 1T-207 | F. nucleatum, S. sanguinis | SPLEKYGTGSMTALTFLLGCCL LVLSKKSR | 273 |
| 1T-208 | Unanalyzed | KRKRWAILTLFLAGLGAVGIVL ATF | 274 |
| 1T-209 | F. nucleatum, S. sanguinis | WSGAAVGAATFC | 275 |
| 1T-210 | S. sanguinis | SVGMGVIERGSFDFSASAILQK RETKCLKNKPFT | 276 |
| 1T-211 | S. sanguinis | AEPIIKVTEG | 277 |
| 1T-212 | S. sanguinis | LLSALIKKLALIIFIG | 278 |
| 1T-213 | S. sanguinis | AYLLTCAAAGGMIGYGAATLD | 279 |
| 1T-214 | S. sanguinis | MIGYGAATLD | 280 |
| 1T-215 | S. sanguinis | VCFKDISVFLSPFRGQEVLFCG KAKHSLIYVIGT | 281 |
| 1T-216 | S. sanguinis | FFLNVIAIRIPHF | 282 |
| 1T-217 | F. nucleatum, S. sanguinis | MLSNVLSRSVVSPNVDIPNSMV ILSPLLISISNYH | 283 |
| 1T-218 | F. nucleatum, S. sanguinis | KLIFAALGLVFLLIGLRDSRSK | 284 |
| 1T-219 | S. sanguinis | RNINVSATFITEKSLV | 285 |
| 1T-220 | A. naeslundii, F. nucleatum, P. gingivalis S. epidermidis, S. gordonii, S. oralis, S. salivarious, S. sanguinis | AILTFFMALLFTYLKEKAQILY WPLFLHLMFYFVTA | 286 |
| 1T-221 | A. naeslundii, F. nucleatum, P. gingivalis S. epidermidis, S. gordonii, S. mitis, S. mutans, S. oralis, S. salivarious, S. sanguinis | DIGRIIGKKGRTITAIRSIVYSVP TQGKKVRLVIDEK | 287 |
| 1T-222 | F. nucleatum, S. sanguinis | RIEASLISAIMFSMFNAIVKFLQK | 288 |
| 1T-223 | A. naeslundii, F. nucleatum, P. gingivalis S. epidermidis, S. gordonii, S. mitis, S. mutans, S. oralis, S. salivarious, S. sanguinis | NQKMEINSMTSEKEKMLAGHF HNEANFAVIFKYSLFYNFF | 289 |
| 1T-224 | A. naeslundii, F. nucleatum, P. gingivalis S. epidermidis, S. gordonii, S. mitis, S. mutans, S. oralis, S. salivarious, S. sanguinis | VHLFSFVKLIYYDIMKYSIEEK VFFESPVGEIIQ | 290 |
| 1T-225 | A. naeslundii, F. nucleatum, P. gingivalis S. epidermidis, S. gordonii, S. mitis, S. mutans, S. oralis, S. salivarious, S. sanguinis | RRSLGNSASFAEWIEYIRYLHYI IRVQFIHFFSKNKKI | 291 |

TABLE 3-continued

Illustrative list of novel targeting peptides.

| ID | Target(s) | Targeting Peptide Sequence | SEQ ID NO: |
|---|---|---|---|
| 1T-226 | A. naeslundii, F. nucleatumS. epidermidis, S. gordonii, S. mitis, S. mutans, S. oralis, S. salivarious, S. sanguinis | KLQEKQIDRNFERVSGYSTYRA VQAAKAKEKGFISLEN | 292 |
| 1T-227 | S. sanguinis | RFEQFFADHYPFV | 293 |
| 1T-228 | A. naeslundii, F. nucleatum, P. gingivalisS. epidermidis, S. gordonii, S. mitis, S. mutans, S. oralis, S. salivarious, S. sanguinis | IFKLFEEHLLYLLDAFYYSKIFR RLKQGLYRRKEQPYTQDLFRM | 294 |
| 1T-229 | S. gordonii, S. oralis, S. sanguinis | LLINYVKVNMSY | 295 |
| 1T-230 | A. naeslundii, F. nucleatum, P. gingivalisS. epidermidis, S. gordonii, S. mitis, S. mutans, S. oralis, S. salivarious, S. sanguinis | EFLEKFKVLKQPRKANNISKNR VAMIFLTIHKSRGFLSSPY | 296 |
| 1T-231 | S. gordonii, S. mitis, S. mutans, S. oralis, S. salivarious | FDFLCSPDSSR | 297 |
| 1T-232 | S. sanguinis | AYSLTFQNPNDNLTDEEVAKY MEKITKALTEKIGAEVR | 298 |
| 1T-233 | A. naeslundii, P. gingivalisS. epidermidis, S. gordonii, S. mitis, S. mutans, S. oralis, S. salivarious, S. sanguinis | TDQELEHLIVTELESKRLDFTYS KDITEFFDEAFPEYDQNY | 299 |
| 1T-234 | A. naeslundii, F. nucleatum, P. gingivalisS. epidermidis, S. gordonii, S. mitis, S. mutans, S. oralis, S. salivarious, S. sanguinis | DNFYLILKMEERGKSKKTSQTR GFRAFFDIIRKKIKKEDGK | 300 |
| 1T-235 | S. sanguinis | GWLSDDFWLKSAIPLLKKRLA KWNETL | 301 |
| 1T-236 | A. naeslundii, F. nucleatum, P. gingivalisS. epidermidis, S. gordonii, S. mitis, S. mutans, S. oralis, S. sanguinis | PVQKALHVVSAYATDLGICYD QVVTVMIREVKTQLYQIY | 302 |
| 1T-237 | S. sanguinis | EDPVPNHFTLRRNKKEKPSKS | 303 |
| 1T-238 | A. naeslundii, F. nucleatum, P. gingivalisS. epidermidis, S. gordonii, S. mitis, S. mutans, S. oralis, S. salivarious, S. sanguinis | IFNRRKFFQYFGLSKEAMVEHI QPFILDIWQIHLF | 304 |
| 1T-239 | A. naeslundiiS. gordonii, S. mitis, S. mutans, S. oralis, S. sanguinis | ADDLLNKRLTDLIMENAETVK TIDLDNSD | 305 |
| 1T-240 | A. naeslundii, F. nucleatum, P. gingivalisS. epidermidis, S. gordonii, S. mitis, S. mutans, S. oralis, S. salivarious, S. sanguinis | VILGNGISNIAQTLGQLPNIAW VWIYMVLIAALLEESNVC | 306 |
| 1T-241 | S. sanguinis | TQKTYLHIIRELENQDIDLIMRS LTSLT | 307 |

TABLE 3-continued

Illustrative list of novel targeting peptides.

| ID | Target(s) | Targeting Peptide Sequence | SEQ ID NO: |
|---|---|---|---|
| 1T-242 | F. nucleatum, S. sanguinis | KQVQNTTLIICGTVLLGILFKSYLKSQKSV | 308 |
| 1T-243 | A. naeslundii, P. gingivalis S. epidermidis, S. gordonii, S. mitis, S. mutants, S. oralis, S. salivarious, S. sanguinis | SENIARFAAAFENEQVVSYARWFRRSWRGSGSSSRF | 309 |
| 1T-244 | A. naeslundii, P. gingivalis S. epidermidis, S. gordonii, S. mitis, S. mutants, S. oralis, S. sanguinis | MTWAEIGAIVGATIGSFYIPNPVIVPFRVR | 310 |
| 1T-245 | F. nucleatum, S. sanguinis | IIGGISGAGVGIASFC | 311 |
| 1T-246 | S. sanguinis | ISGAGVGIASFC | 312 |
| 1T-247 | A. naeslundii, F. nucleatum, P. gingivalis S. epidermidis, S. gordonii, S. mitis, S. mutants, S. oralis, S. salivarious, S. sanguinis | LSISQRTDRVIVMDKGKIIEEGTHSELIAANGFYHHLFNK | 313 |
| 1T-248 | S. sanguinis | IGGALNSCG | 314 |
| 1T-249 | F. nucleatum, S. sanguinis | VFSVLKHTTWPTRKQSWHDFISILEYSAFFALVIFIFDKLLTLGLAELLKRF | 315 |
| 1T-250 | S. mitis, S. mutans, S. oralis | LVQGDTILIENHVGTPVKDDGKDCLIIREADVLAVVND | 316 |
| 1T-251 | S. mitis, S. oralis, S. sanguinis | LVMNDETIYLFTYENGQISYEEDKRDCSKNV | 317 |
| 1T-252 | F. nucleatum, S. sanguinis | MKKNLKRFYALVLGFIIGCLFVSILIFIGY | 318 |
| 1T-253 | A. naeslundii, F. nucleatum, P. gingivalis S. epidermidis, S. gordonii, S. mitis, S. mutants, S. oralis, S. salivarious, S. sanguinis | KTKESLTQQEKKFLKDYDRKSLHHFRDILTYCFILDKLTNK | 319 |
| 1T-254 | S. sanguinis | RFLKDELSVSVRLQEKSIEALPFRTKIEIEIESDNQIKTL | 320 |
| 1T-255 | A. naeslundii, F. nucleatum, P. gingivalis S. epidermidis, S. gordonii, S. mitis, S. mutants, S. oralis, S. salivarious, S. sanguinis | LFIVEYKDKASVPGEIDNTYVESYTYSDILTEKTLIRYFD | 321 |
| 1T-256 | S. sanguinis | KGKSLMPLLKQINQWGKLYL | 322 |
| 1T-257 | A. naeslundii, F. nucleatum, P. gingivalis S. epidermidis, S. gordonii, S. mitis, S. mutants, S. oralis, S. salivarious, S. sanguinis | IILAKAADLAEIERIISEDPFKINEIANYDIIEFCPTKSSKAFEKVLK | 323 |
| 1T-258 | A. naeslundii, F. nucleatum, P. gingivalis, T. denticola, S. mitis, S. mutans, S. oralis | TINIDDKVLDYLKKINSKAITIDLIGCAS | 324 |
| 1T-259 | F. nucleatum, P. gingivalis, T. denticola, S. mitis, S. mutans, S. oralis, S. sanguinis | EKLKKILLKLAVCGKAWYTL | 325 |

TABLE 3-continued

Illustrative list of novel targeting peptides.

| ID | Target(s) | Targeting Peptide Sequence | SEQ ID NO: |
|---|---|---|---|
| 1T-260 | A. naeslundii, P. gingivalis S. epidermidis, S. gordonii, S. mitis, S. mutans, S. oralis, S. sanguinis | NILYFIHDENQWEPQKAEIFRG SIKHCAWLSS | 326 |
| 1T-261 | F. nucleatum S. mutans, S. oralis S. sanguinis | SFEKNKIENNLKIAQAYIYIKPK PRICQA | 327 |
| 1T-262 | A. naeslundii, F. nucleatum, P. gingivalis S. epidermidis, S. gordonii, S. mitis, S. mutans, S. oralis, S. salivarious, S. sanguinis | LSLPLIVLTKSI | 328 |
| 1T-263 | A. naeslundii, F. nucleatum, P. gingivalis S. epidermidis, S. gordonii, S. mitis, S. oralis, S. salivarious, S. sanguinis | FIAVSFTGNPATFKLVIGCKADN | 329 |
| 1T-264 | S. sanguinis | LEGKFYMAEDFDKTPECFKDYV | 330 |
| 1T-265 | A. naeslundii, F. nucleatum, P. gingivalis S. epidermidis, S. gordonii, S. mitis, S. mutans, S. oralis, S. salivarious, S. sanguinis | GMFENLLMINFQIMNDLKIEIV VKDRICAV | 331 |
| 1T-266 | S. sanguinis | RAGTWLVVDEIR | 332 |
| 1T-267 | A. naeslundii, F. nucleatum, P. gingivalis, T. denticola, S. mitis, S. mutans, S. oralis S. sanguinis | RIKEERKNRSYKFFIWRLFDEK TGFI | 333 |
| 1T-268 | F. nucleatum S. mutans, S. oralis S. sanguinis | PITPKKEKCGLGTYAPKNPVFS KSRV | 334 |
| 1T-269 | F. nucleatum S. mutans, S. oralis S. sanguinis | PLYVAAVEKINTAKKH | 335 |
| 1T-270 | F. nucleatum S. mutans, S. oralis S. sanguinis | VHEFDIQKILQNR | 336 |
| 1T-271 | A. naeslundii, F. nucleatum, P. gingivalis S. epidermidis, S. gordonii, S. mitis, S. mutans, S. oralis, S. salivarious, S. sanguinis | FLIQKFLLIKTFPPYRKKYVVIV SQTGTA | 337 |
| 1T-272 | F. nucleatum S. mutans, S. oralis S. sanguinis | QLAPIDKQLKAVKKIAFYESES TAAKAVTVA | 338 |
| 1T-273 | F. nucleatum, P. gingivalis, T. denticola, S. mitis, S. mutans, S. oralis | YNEPNYKWLESYKIYKQRCED RTGMYYTEET | 339 |
| 1T-274 | F. nucleatum S. mutans, S. oralis S. sanguinis | ETTTEINAIKLHRIKQRSPQGTR RVN | 340 |
| 1T-275 | A. naeslundii, F. nucleatum, P. gingivalis, T. denticola, S. epidermidis, S. gordonii, S. mitis, S. mutans, S. oralis, S. salivarious, S. sanguinis | QVLKNFSISRRYKINNPFFKILL FIQLRTL | 341 |
| 1T-276 | A. naeslundii, F. nucleatum, P. gingivalis S. epidermidis, | ILTLLILGSIGFFILKIKLKLGRF | 342 |

TABLE 3-continued

Illustrative list of novel targeting peptides.

| ID | Target(s) | Targeting Peptide Sequence | SEQ ID NO: |
|---|---|---|---|
| | S. gordonii, S. mitis, S. mutans, S. oralis, S. sanguinis | | |
| 1T-277 | A. naeslundii, F. nucleatum, P. gingivalis, T. denticola S. gordonii, S. mitis, S. mutans, S. oralis, S. salivarious, S. sanguinis | IYYMRFVNKPLEKTFFKI | 343 |
| 1T-278 | A. naeslundii, F. nucleatum, P. gingivalis, S. gordonii, S. mitis, S. mutans, S. oralis, S. salivarious, S. sanguinis | SINSSAGIQPHCLSSSFVLRTKH CFY | 344 |
| 1T-279 | A. naeslundii, F. nucleatum, P. gingivalis, S. gordonii, S. mitis, S. mutans, S. oralis, S. salivarious, S. sanguinis | FVLRTKHCFY | 345 |
| 1T-280 | A. naeslundii, F. nucleatum, P. gingivalis, T. denticola S. gordonii, S. mitis, S. mutans, S. oralis, S. salivarious, S. sanguinis | TNNKNKVIIKAIKFKNKDFINL DLFIYRR | 346 |
| 1T-281 | A. naeslundii, F. nucleatum, P. gingivalis S. epidermidis, S. gordonii, S. mitis, S. mutans, S. oralis, S. salivarious, S. sanguinis | KYEKLTKENLFIRNSGNMCVFI YFLFFG | 347 |
| 1T-282 | F. nucleatum, P. gingivalis, S. gordonii, S. mitis, S. mutans, S. oralis, S. salivarious, S. sanguinis | ISLVFPAYT | 348 |
| 1T-283 | A. naeslundii, F. nucleatum, P. gingivalis, T. denticola, S. epidermidis, S. gordonii, S. mitis, S. mutans, S. oralis, S. salivarious, S. sanguinis | LCTKLEDKQRGRIPAELFIISPIK ILERNDAL | 349 |
| 1T-284 | A. naeslundii, F. nucleatum, P. gingivalis, S. gordonii, S. mitis, S. mutans, S. oralis, S. salivarious, S. sanguinis | FQYYFSLKRV | 350 |
| 1T-285 | A. naeslundii, F. nucleatum, P. gingivalis, S. gordonii, S. mitis, S. mutans, S. oralis, S. salivarious, S. sanguinis | FFPYYLADFYKQLKFLNEYQT KNKDKVVEFK | 351 |
| 1T-286 | S. sanguinis | LGFFNNKADLVKADTERDNRM SSLKIKDL | 352 |
| 1T-287 | P. gingivalis, T. denticola S. gordonii, S. mitis, S. mutans, S. oralis, S. salivarious, S. sanguinis | KGYPLPFQYRLNNH | 353 |
| 1T-288 | F. nucleatum, S. gordonii, S. salivarious, S. sanguinis | RWVGGEPSADIYLSAKDTKT | 354 |
| 1T-289 | F. nucleatum, P. gingivalis, S. gordonii, S. mitis, S. mutans, S. oralis, S. sanguinis | EPSADIYLSAKDTKT | 355 |

TABLE 3-continued

Illustrative list of novel targeting peptides.

| ID | Target(s) | Targeting Peptide Sequence | SEQ ID NO: |
|---|---|---|---|
| 1T-290 | A. naeslundii, F. nucleatum, P. gingivalis, S. gordonii, S. mitis, S. mutans, S. oralis, S. salivarious, S. sanguinis | IINQLNLILLRLMEILIL | 356 |
| 1T-291 | A. naeslundii, F. nucleatum, P. gingivalis, T. denticola, S. mitis, S. mutans, S. oralis | DMKIIKLYIKILSFLFIKYCNKK LNSVKLKA | 357 |
| 1T-292 | A. naeslundii, F. nucleatum, P. gingivalis S. epidermidis, S. gordonii, S. mitis, S. mutans, S. oralis, S. salivarious, S. sanguinis | IINQLNLILLRLMEILIL | 358 |
| 1T-293 | A. naeslundii, F. nucleatum, P. gingivalis S. epidermidis, S. gordonii, S. mitis, S. mutans, S. oralis, S. salivarious, S. sanguinis | HVEDCFLLSNARTTAIHGRANP ARGEPRTRSE | 359 |
| 1T-294 | T. denticola | YDKIADGVFKIGKRGVL | 360 |
| 1T-295 | S. mitis, S. salivarious, S. sanguinis | KYKLKKIIL | 361 |
| 1T-296 | A. naeslundii, F. nucleatum, P. gingivalis, S. gordonii, S. mitis, S. mutans, S. oralis, S. salivarious, S. sanguinis | EYSQQSFKAKPCSERGVLSP | 362 |
| 1T-297 | A. naeslundii, F. nucleatum, T. denticola, S. mitis, S. mutans, S. oralis | RSLRLNNALTKLPKLWYNRIKE AFYAYNDYDK | 363 |
| 1T-298 | A. naeslundii, F. nucleatum, P. gingivalis, T. denticola S. gordonii, S. mitis, S. mutans, S. oralis, S. salivarious, S. sanguinis | ILNKKPKLPLWKLGKNYFRRF YVLPTFLA | 364 |
| 1T-299 | A. naeslundii, F. nucleatum S. epidermidis, S. gordonii, S. mitis, S. mutans, S. oralis, S. salivarious, S. sanguinis | SMLTSFLRSKNTRSLKMYKDV HF | 365 |
| 1T-300 | A. naeslundii, F. nucleatum, P. gingivalis S. epidermidis, S. gordonii, S. mitis, S. mutans, S. oralis, S. salivarious, S. sanguinis | PLIISKAQIKMSGDILGSCFKLF YLRPFF | 366 |
| 1T-301 | F. nucleatum, S. gordonii, S. sanguinis | SKLPRVLDASLKL | 367 |
| 1T-302 | A. naeslundii, P. gingivalis S. epidermidis, S. gordonii, S. mitis, S. mutans, S. oralis, S. salivarious, S. sanguinis | IIIILPKIYLVCKTV | 368 |
| 1T-303 | A. naeslundii, F. nucleatum, P. gingivalis, S. gordonii, S. mitis, S. mutans, S. oralis, S. salivarious, S. sanguinis | LDYENMDCKKRIRI | 369 |

TABLE 3-continued

Illustrative list of novel targeting peptides.

| ID | Target(s) | Targeting Peptide Sequence | SEQ ID NO: |
|---|---|---|---|
| TT-304 | P. gingivalis | STAGEASRRTASEASRRTAAKLRG | 370 |
| TT-305 | F. nucleatum | ARNALNMRDVPVDAAIIGIIDGMDEE | 371 |
| TT-306 | F. nucleatum | KILNEAEGKLLKVIEKNGEIDIEEI | 372 |
| TT-307 | F. nucleatum | NGDKKAKEELDKWDEVIKELNIQF | 373 |
| TT-308 | F. nucleatum | GLVIIPNLIALIILFSQVRQQTKDYFSNPKLSSR | 374 |
| TT-309 | F. nucleatum | EPLPLTKYDKKDTEMKKVFKEILAGKVGYEKEEE | 375 |
| TT-310 | F. nucleatum | TKLKKNNKLLSAKKENTLHTKDK | 376 |
| TT-311 | S. mutans, S. sobrinus | AIFDAMHNL | 377 |

As described above, in certain embodiments of the present invention, the targeting moiety can comprise targeting peptide capable of binding, specifically binding, or preferentially binding to a microorganism, e.g., a target microbial organism. In one embodiment, the targeting peptide be identified via screening peptide libraries. For example, a phage display peptide library can be screened against a target microbial organism or a desired antigen or epitope thereof. Any peptide identified through such screening can be used as a targeting peptide for the target microbial organism. Illustrative additional targeting peptides are shown in Table 4.

TABLE 4

Additional illustrative targeting moieties.

| Targeting Moiety/Organism | Structure/sequence | SEQ ID NO |
|---|---|---|
| LPSB-1 | RGLRRLGRRGLRRLGR | 378 |
| Phob-1 | KPVLPVLPVLPVL | 379 |
| LPSB-2 | VLRIIRIAVLRIIRIA | 380 |
| LPTG-1 | LPETGGSGGSLPETG | 381 |
| α-1 | RAHIRRAHIRR | 382 |
| ANION-1 | DEDEDDEEDDDEEE | 383 |
| PHILIC-1 | STMCGSTMCGSTMCG | 384 |
| SA5.1/S. aureus | VRLPLWLPSLNE | 385 |
| SA5.3/S. aureus | ANYFLPPVLSSS | 386 |
| SA5.4/S. aureus | SHPWNAQRELSV | 387 |
| SA5.5/S. aureus | SVSVGMRPMPRP | 388 |
| SA5.6/S. aureus | WTPLHPSTNRPP | 389 |
| SA5.7/S. aureus | SVSVGMKPSPRP | 390 |
| SA5.8/S. aureus | SVSVGMKPSPRP | 391 |
| SA5.9/S. aureus | SVPVGPYNESQP | 392 |
| SA5.10/S. aureus | WAPPLFRSSLFY | 393 |
| SA2.2/S. aureus | WAPPXPXSSLFY | 394 |

TABLE 4-continued

Additional illustrative targeting moieties.

| Targeting Moiety/Organism | Structure/sequence | SEQ ID NO |
|---|---|---|
| SA2.4/*S. aureus* | HHGWTHHWPPPP | 395 |
| SA2.5/*S. aureus* | SYYSLPPIFHIP | 396 |
| SA2.6/*S. aureus* | HFQENPLSRGGEL | 397 |
| SA2.7/*S. aureus* | FSYSPTRAPLNM | 398 |
| SA2.8/*S. aureus* | SXPXXMKXSXXX | 399 |
| SA2.9/*S. aureus* | VSRHQSWHPHDL | 400 |
| SA2.10/*S. aureus* | DYXYRGLPRXET | 401 |
| SA2.11/*S. aureus* | SVSVGMKPSPRP | 402 |
| *S. aureus*/Consensus | V/Q/H-P/H-H-E-F/Y-K/H-H/A-L/H-X-X-K/R-P/L | 403 |
| DH5.1/*E. coli* | KHLQNRSTGYET | 404 |
| DH5.2/*E. coli* | HIHSLSPSKTWP | 405 |
| DH5.3/*E. coli* | TITPTDAEMPFL | 406 |
| DH5.4/*E. coli* | HLLESGVLERGM | 407 |
| DH5.5/*E. coli* | HDRYHIPPLQLH | 408 |
| DH5.6/*E. coli* | VNTLQNVRHMAA | 409 |
| DH5.7/*E. coli* | SNYMKLRAVSPF | 410 |
| DH5.8/*E. coli* | NLQMPYAWRTEF | 411 |
| DH5.9/*E. coli* | QKPLTGPHFSLI | 412 |
| CSP/*S. mutans* | SGSLSTFFRLFNRSFTQALGK | 413 |
| CSPC18/*S. mutans* | LSTFFRLFNRSFTQALGK | 414 |
| CSPC16/*S. mutans* | TFFRLFNRSFTQALGK | 415 |
| CSPM8/*S. mutans* | TFFRLFNR | 416 |
| KH/*Pseudomonas spp* (US 2004/0137482) | KKHRKHRKHRKH | 417 |
| cCF10 | LVTLVFV | 418 |
| AgrD1 | YSTCDFIM | 419 |
| AgrD2 | GVNACSSLF | 420 |
| AgrD3 | YINCDFLL | 421 |
| NisinA | ITSISLCTPGCKTGALMGCNMRTATCIICSIIIVSK | 422 |
| PlnA | KSSAYSLQMGATAIKQVKKLFKKWGW | 423 |
| S3L1-5 | WWYNWWQDW | 424 |
| Penetratin | RQIKIWFWNRRMKWKK* | 425 |
| Tat | EHWSYCDLRPG | 426 |
| Pep-1N | KETWWETWWTEW | 427 |
| Pep27 | MRKEFHNVLSSGQLLADKRPARDYNRK | 428 |
| HABP35 | LKQKIKHVVKLKVVVKLRSQLVKRKQN | 429 |
| HABP42 (all D) | STMMSRSHKTRSHHV | 430 |
| HABP52 | GAHWQFNALTVRGGGS | 431 |

TABLE 4-continued

Additional illustrative targeting moieties.

| Targeting Moiety/ Organism | Structure/sequence | SEQ ID NO |
|---|---|---|
| Hi3/17 | KQRTSIRATEGCLPS | 432 |
| α-E. coli peptide | QEKIRVRLSA | 433 |
| Salivary Receptor Adhesion Fragment | QLKTADLPAGRDETTSFVLV* | 434 |
| S1 (Sushi frag.) (LPS binding) | GFKLKGMARISCLPNGQWSNFPPKCIRECAMVSS | 435 |
| S3 (Sushi frag.) (LPS binding) | HAEHKVKIGVEQKYGQFPQGTEVTYTCSGNYFLM | 436 |
| MArg.1 (Mycoplasma infected cell line binding peptide | AMDMYSIEDRYFGGYAPEVG | 437 |
| BPI fragment 1 (LPS binding) 6,376,462 | ASQQGTAALQKELKRIKPDYSDSFKIKH | 438 |
| BPI fragment 2 (LPS binding) 6,376,462 | SSQISMVPNVGLKFSISNANIKISGKWKAQKRFLK | 439 |
| BPI fragment 3 (LPS binding) 6,376,462 | VHVHISKSKVGWLIQLFHKKIESALRNK | 440 |
| LBP fragment 1 (LPS binding) 6,376,462 | AAQEGLLALQSELLRITLPDFTGDLRIPH | 441 |
| LBP fragment 2 (LPS binding) 6,376,462 | HSALRPVPGQGLSLSISDSSIRVQGRWKVRKSFFK | 442 |
| LBP fragment 3 (LPS binding) 6,376,462 | VEVDMSGDLGWLLNLFHNQIESKFQKV | 443 |
| B. anthracis spore binding (WO/1999/036081) | ATYPLPIR | 444 |
| Bacillus spore binding (WO/1999/036081) | peptides of 5-12 amino acids containing the sequence Asn-His-Phe-Leu | 445 |
| | peptides of 5-12 amino acids containing the sequence Asn-His-Phe-Leu-Pro | 446 |
| | Thr-Ser-Glu-Asn-Val-Arg-Thr (TSQNVRT) | 447 |
| | A peptide of formula Thr-Tyr-Pro-X-Pro-X-Arg (TYPXPXR) where X is a Ile, Val or Leu. | 448 |
| | A peptide having the sequence TSQNVRT. | 449 |
| | A peptide having the sequence TYPLPIR | 450 |
| LPS binding peptide 1 (6,384,188) | TFRRLKWK | 451 |
| LPS BP 2 (6,384,188) | RWKVRKSFFKLQ | 452 |
| LPS BP 3 (6,384,188) | KWKAQKRFLKMS | 453 |
| Pseudomonas pilin binding peptide (5,494,672) | KCTSDQDEQFIPKGCSK | 454 |

Patents and patent publications disclosing the referenced antibodies are identified in the table.

In certain embodiments the targeting moieties can comprise other entities, particularly when utilized with an antimicrobial peptide as described, for example, in Table 2. Illustrative targeting moieties can include a polypeptide, a peptide, a small molecule, a ligand, a receptor, an antibody, a protein, or portions thereof that specifically interact with a target microbial organism, e.g., the cell surface appendages such as flagella and pili, and surface exposed proteins, lipids and polysaccharides of a target microbial organism.

Targeting Antibodies.

In certain embodiments the targeting moieties can comprise one or more antibodies that bind specifically or preferentially a microorganism or group of microorganisms (e.g., bacteria, fungi, yeasts, protozoa, viruses, algae, etc.). The antibodies are selected to bind an epitope characteristic or the particular target microorganism(s). In various embodiments such epitopes or antigens are typically is gram-positive or gram-negative specific, or genus-specific, or species-specific, or strain specific and located on the surface of a target microbial organism. The antibody that binds the epitope or antigen can direct an anti-microbial peptide moiety or other effector to the site. Furthermore, in certain embodiments the antibody itself can provide anti-microbial activity in addition to the activity provided by effector moiety since the antibody may engage an immune system effector (e.g., a T-cell) and thereby elicit an antibody-associated immune response, e.g., a humoral immune response.

Antibodies that bind particular target microorganisms can be made using any methods readily available to one skilled in the art. For example, as described in U.S. Pat. No. 6,231,857 (incorporated herein by reference) three monoclonal antibodies, i.e., SWLA1, SWLA2, and SWLA3 have been made against *S. mutans*. Monoclonal antibodies obtained from non-human animals to be used in a targeting moiety can also be humanized by any means available in the art to decrease their immunogenicity and increase their ability to elicit anti-microbial immune response of a human. Illustrative microorganisms and/or targets to which antibodies may be directed are shown, for example, in Tables 5.

Various forms of antibody include, without limitation, whole antibodies, antibody fragments (e.g., (Fab')$_2$, Fab', etc.), single chain antibodies (e.g., scFv), minibodies, Di-miniantibody, Tetra-miniantibody, (scFv)$_2$, Diabody, scDiabody, Triabody, Tetrabody, Tandem diabody, VHH, nanobodies, affibodies, unibodies, and the like.

Methods of making such antibodies are well known to those of skill in the art. In various embodiments, such methods typically involve providing the microorganism, or a component thereof for use as an antigen to raise an immune response in an organism or for use in a screening protocol (e.g., phage or yeast display).

For example, polyclonal antibodies are typically raised by one or more injections (e.g. subcutaneous or intramuscular injections) of the target microorganism(s) or components thereof into a suitable non-human mammal (e.g., mouse, rabbit, rat, etc.).

If desired, the immunizing microorganism or antigen derived therefrom can be administered with or coupled to a carrier protein by conjugation using techniques that are well-known in the art. Such commonly used carriers which are chemically coupled to the peptide include keyhole limpet hemocyanin (KLH), thyroglobulin, bovine serum albumin (BSA), and tetanus toxoid. The coupled peptide is then used to immunize the animal (e.g. a mouse or a rabbit).

The antibodies are then obtained from blood samples taken from the mammal. The techniques used to develop polyclonal antibodies are known in the art (see, e.g., *Methods of Enzymology*, "Production of Antisera With Small Doses of Immunogen: Multiple Intradermal Injections", Langone, et al. eds. (Acad. Press, 1981)). Polyclonal antibodies produced by the animals can be further purified, for example, by binding to and elution from a matrix to which the peptide to which the antibodies were raised is bound. Those of skill in the art will know of various techniques common in the immunology arts for purification and/or concentration of polyclonal antibodies, as well as monoclonal antibodies see, for example, Coligan, et al. (1991) Unit 9, *Current Protocols in Immunology*, Wiley Interscience).

In certain embodiments the antibodies produced will be monoclonal antibodies ("mAb's"). The general method used for production of hybridomas secreting mAbs is well known (Kohler and Milstein (1975) *Nature*, 256:495

Antibody fragments, e.g. single chain antibodies (scFv or others), can also be produced/selected using phage display and/or yeast display technology. The ability to express antibody fragments on the surface of viruses that infect bacteria (bacteriophage or phage) or yeasts makes it possible to isolate a single binding antibody fragment, e.g., from a library of greater than $10^{10}$ nonbinding clones. To express antibody fragments on the surface of phage (phage display) or yeast, an antibody fragment gene is inserted into the gene encoding a phage surface protein (e.g., pIII) and the antibody fragment-pIII fusion protein is displayed on the phage surface (McCafferty et al. (1990) *Nature*, 348: 552-554; Hoogenboom et al. (1991) *Nucleic Acids Res.* 19: 4133-4137).

Since the antibody fragments on the surface of the phage or yeast are functional, phage bearing antigen binding antibody fragments can be separated from non-binding phage by antigen affinity chromatography (McCafferty et al. (1990) *Nature*, 348: 552-554). Depending on the affinity of the antibody fragment, enrichment factors of 20 fold-1,000,000 fold are obtained for a single round of affinity selection.

Human antibodies can be produced without prior immunization by displaying very large and diverse V-gene repertoires on phage (Marks et al. (1991) *J. Mol. Biol.* 222: 581-597.

In certain embodiments, nanobodies can be used as targeting moieties. Methods of making $V_hH$ (nanobodies) are also well known to those of skill in the art. The Camelidae heavy chain antibodies are found as homodimers of a single heavy chain, dimerized via their constant regions. The variable domains of these camelidae heavy chain antibodies are referred to as $V_{HH}$ domains or $V_{HH}$, and can be either used per se as nanobodies and/or as a starting point for obtaining nanobodies. Isolated $V_{HH}$ retain the ability to bind antigen with high specificity (see, e.g., Hamers-Casterman et al. (1993) *Nature* 363: 446-448). In certain embodiments such $V_{HH}$ domains, or nucleotide sequences encoding them, can be derived from antibodies raised in Camelidae species, for example in camel, dromedary, llama, alpaca and guanaco. Other species besides Camelidae (e.g. shark, pufferfish) can produce functional antigen-binding heavy chain antibodies, from which (nucleotide sequences encoding) such naturally occurring $V_{HH}$ can be obtained, e.g. using the methods described in U.S. Patent Publication US 2006/0211088.

In various embodiments, for use in therapy, human proteins are preferred, primarily because they are not as likely to provoke an immune response when administered to a patient. Comparisons of camelid $V_{HH}$ with the $V_H$ domains of human antibodies reveals several key differences in the framework regions of the camelid $V_{HH}$ domain corresponding to the $V_H/V_L$ interface of the human $V_H$ domains. Mutation of these human residues to $V_{HH}$ resembling residues has been performed to produce "camelized" human $V_H$ domains that retain antigen binding activity, yet have improved expression and solubility.

Libraries of single $V_H$ domains have also been derived for example from $V_H$ genes amplified from genomic DNA or from mRNA from the spleens of immunized mice and expressed in *E. coli* (Ward et al. (1989) *Nature* 341: 544-546) and similar approaches can be performed using the $V_H$ domains and/or the $V_L$ domains described herein. The isolated single VH domains are called "dAbs" or domain antibodies. A "dAb" is an antibody single variable domain ($V_H$ or $V_L$) polypeptide that specifically binds antigen. A "dAb" binds antigen independently of other V domains; however, as the term is used herein, a "dAb" can be present in a homo- or heteromultimer with other $V_H$ or $V_L$ domains where the other domains are not required for antigen binding by the dAb, i.e., where the dAb binds antigen independently of the additional $V_H$ or $V_L$ domains.

As described in U.S. Patent Publication US 2006/0211088 methods are known for the cloning and direct screening of immunoglobulin sequences (including but not limited to multivalent polypeptides comprising: two or more variable domains—or antigen binding domains—and in particular $V_H$ domains or $V_{HH}$ domains; fragments of $V_L$, $V_H$ or $V_{HH}$ domains, such as CDR regions, for example CDR3 regions; antigen-binding fragments of conventional 4-chain antibodies such as Fab fragments and scFv's, heavy chain antibodies and domain antibodies; and in particular of $V_H$ sequences, and more in particular of $V_{HH}$ sequences) that can be used as part of and/or to construct such nanobodies.

Methods and procedures for the production of VHH/nanobodies can also be found for example in WO 94/04678, WO 96/34103, WO 97/49805, WO 97/49805 WO 94/25591, WO 00/43507 WO 01/90190, WO 03/025020, WO 04/062551, WO 04/041863, WO 04/041865, WO 04/041862, WO 04/041867, PCT/BE2004/000159, Hamers-Casterman et al. (1993) *Nature* 363: 446; Riechmann and Muyldermans (1999) *J. Immunological Meth.*, 231: 25-38; Vu et al. (1997) *Molecular Immunology*, 34(16-17): 1121-1131; Nguyen et al. (2000) *EMBO J.*, 19(5): 921-930; Arbabi Ghahroudi et al. (19997) *FEBS Letters* 414: 521-526; van der Linden et al. (2000) *J. Immunological Meth.*, 240: 185-195; Muyldermans (2001) *Rev. Molecular Biotechnology* 74: 277-302; Nguyen et al. (2001) *Adv. Immunol.* 79: 261, and the like, which are all incorporated herein by reference.

In certain embodiments the antibody targeting moiety is a unibody. Unibodies provide an antibody technology that produces a stable, smaller antibody format with an anticipated longer therapeutic window than certain small antibody formats. In certain embodiments unibodies are produced from IgG4 antibodies by eliminating the hinge region of the antibody. Unlike the full size IgG4 antibody, the half molecule fragment is very stable and is termed a uniBody. Halving the IgG4 molecule left only one area on the UniBody that can bind to a target. Methods of producing unibodies are described in detail in PCT Publication WO2007/059782, which is incorporated herein by reference in its entirety (see, also, Kolfschoten et al. (2007) *Science* 317: 1554-1557).

Affibody molecules are class of affinity proteins based on a 58-amino acid residue protein domain, derived from one of the IgG-binding domains of staphylococcal protein A. This three helix bundle domain has been used as a scaffold for the construction of combinatorial phagemid libraries, from which Affibody variants that target the desired molecules can be selected using phage display technology (see, e.g., Nord et al. (1997) *Nat. Biotechnol.* 15: 772-777; Ronmark et al. (2002) *Eur. J. Biochem.*, 269: 2647-2655). Details of Affibodies and methods of production are known to those of skill (see, e.g., U.S. Pat. No. 5,831,012 which is incorporated herein by reference in its entirety).

It will also be recognized that antibodies can be prepared by any of a number of commercial services (e.g., Berkeley antibody laboratories, Bethyl Laboratories, Anawa, Eurogenetec, etc.).

Illustrative antibodies that bind various microorganisms are shown in Table 5.

TABLE 5

Illustrative antibodies that bind target microorganisms.

| Source | Antibody |
| --- | --- |
| 7,195,763 | Polyclonal/monoclonal binds specific Gram(+) cell wall repeats |
| 6,939,543 | Antibodies against G(+) LTA |
| 7,169,903 | Antibodies against G(+) peptidoglycan |
| 6,231,857 | Antibody against *S. mutans* (Shi) |
| 5,484,591 | Gram(−) binding antibodies |
| US 2007/0231321 | Diabody binding to *Streptococcus* surface antigen I/II |
| US 2003/0124635 | Antibody against *S. mutans* |
| US 2006/0127372 | Antibodies to *Actinomyces naeslundii*, *Lactobacillus casei* |
| US 2003/0092086 | Antibody to *S. sobrinus* |

In addition, antibodies (targeting moieties) that bind other microorganisms can readily be produced using, for example, the methods described above.

Porphyrins.

In certain embodiments porphyrins, or other photosensitizing agents, can be used as targeting moieties in the constructs described herein. In particular, metalloporphyrins, particularly a number of non-iron metalloporphyrins mimic heme in their molecular structure and are actively accumulated by bacteria via high affinity heme-uptake systems. The same uptake systems can be used to deliver antibiotic-porphyrin and antibacterial-porphyrin conjugates. Illustrative targeting porphyrins suitable for this purpose are described in U.S. Pat. No. 6,066,628 and shown herein, for example, in FIGS. 1 and 2.

For example, certain artificial (non-iron) metalloporphyrins (MPs) (Ga-IX, Mn-IX,) are active against Gram-negative and Gram-positive bacteria and acid-fast bacilli (e.g., *Y. enterocolitica, N. meningitides, S. marcescens, E. coli, P. mirabills, K. pneumoniae, K. oxytoca, Ps. aeruginosa, C. freundii, E. aerogenes, F. menigosepticum, S. aureus, B. subtilis, S. pyogenes A, E. faecalis, M. smegmatis, M. bovis, M. tuber., S. cerevisiae*) as described in Tables 1-5 of U.S. Pat. No. 6,066,628. These MPs can be used as targeting moieties against these microorganisms.

Similarly, some MPs are also growth-inhibitory against yeasts, indicating their usefulness targeting moieties to target *Candida* species (e.g., *Candida albicans, C. krusei, C. pillosus, C. glabrata*, etc.) and other mycoses including but not limited to those caused by as *Trichophyton, Epidermophyton, Histoplasma, Aspergillus, Cryptococcus*, and the like.

Porphyrins, and other photosensitizers, also have antimicrobial activity. Accordingly, in certain embodiments, the porphyrins, or other photosensitizers, can be used as effectors (e.g., attached to targeting peptides as described herein). In various embodiments the porphyrins or other photosensitizers can provide a dual functionality, e.g., as a targeting moiety and an antimicrobial and can be attached to a targeting peptide and/or to an antimicrobial peptide as described herein.

Illustrative porphyrins and other photosensitizers are shown in FIGS. 1-11 and described in more detail in the discussion of effectors below.

Pheromones.

In certain embodiments, pheromones from microorganisms can be used as targeting moieties. Illustrative pheromones from bacteria and fungi are shown in Table 6. In certain embodiments, chimeric moieties are contemplated comprising a targeting moiety comprising or consisting of the amino acid sequence (or retro or retro-inverso or beta) sequence of a peptide shown in Table 6 attached to one or more of the peptides shown in Table 2.

TABLE 6

Illustrative bacterial and fungal pheromones utilizable as targeting moieties.

Bacterial Pheromones

| Locus tag | Product | Sequence | SEQ ID |
|---|---|---|---|
| gi\|1041118\|dbj\|BAA11198.1\| | iPD1 [Enterococcus faecalis] | MKQQKKHIAALLF ALILTLVS | 455 |
| gi\|1113947\|gb\|AAB35253.1\| | iAM373sex pheromone inhibito [Enterococcus faecalis, Peptide, 7 aa] | SIFTLVA | 456 |
| gi\|115412\|sp\|P13268.1\|CAD1_ENTFA | Sex pheromone CAD1 | LFSLVLAG | 457 |
| gi\|116406\|sp\|P11932.1\|CIA_ENTFA | Sex pheromone cAM373 (Clumping-inducing agent) (CIA) | AIFILAS | 458 |
| gi\|117240\|sp\|P13269.1\|CPD1_ENTFA | Sex pheromone cPD1 | FLVMFLSG | 459 |
| gi\|12056953\|gb\|AAG48144.1\|AF322594_1 | putative peptide pheromone PrcA [Lactobacillus paracasei] | DSIRDVSPTFNKIRR WFDGLFK | 460 |
| gi\|123988\|sp\|P24803.1\|IAD1_ENTFA | Sex pheromone inhibitor determinant precursor (iAD1) | MSKRAMKKIIPLIT LFVVTLVG | 461 |
| gi\|126362994\|emb\|CAM35812.1\| | precursor of pheromone peptide ComX [Bacillus amyloliquefaciens FZB42] | KDEIYWKPS | 462 |
| gi\|1587088\|prf\|\|2205353A | pheromone | YSTCDFIM | 463 |
| gi\|15900442\|ref\|NP_345046.1\| | peptide pheromone BlpC [Streptococcus pneumoniae TIGR4] | GLWEDLLYNINRY AHYIT | 464 |
| gi\|1617436\|emb\|CAA66791.1\| | competence pheromone [Streptococcus gordonii] | DIRHRINNSIWRDIF LKRK | 465 |
| gi\|1617440\|emb\|CAA66786.1\| | competence pheromone [Streptococcus gordonii] | DVRSNKIRLWWEN IFFNKK | 466 |
| gi\|18307870\|gb\|AAL67728.1\|AF456134_2 | ComX pheromone precursor [Bacillus mojavensis] | PTTREWDG | 467 |
| gi\|18307874\|gb\|AAL67731.1\|AF456135_2 | ComX pheromone precursor [Bacillus mojavensis] | LQIYTNGNWVPS | 468 |
| gi\|29377808\|ref\|NP_816936.1\| | sex pheromone inhibitor determinant [Enterococcus faecalis V583] | MSKRAMKKIIPLIT LFVVTLVG | 469 |
| gi\|3342125\|gb\|AAC27522.1\| | putative pheromone [Enterococcus faecium] | GAGKNLIYGMGYG YLRSCNRL | 470 |
| gi\|41018893\|sp\|P60242.1\|CSP1_STRPN | Competence-stimulating peptide type 1 precursor (CSP-1) | EMRLSKFFRDFILQ RKK | 471 |
| gi\|57489126\|gb\|AAW51333.1\| | PcfP [Enterococcus faecalis] | WSEIEINTKQSN | 472 |
| gi\|57489152\|gb\|AAW51349.1\| | PrgT [Enterococcus faecalis] | HISKERFEAY | 473 |
| gi\|58616083\|ref\|YP_195761.1\| | UvaF [Enterococcus faecalis] | KYKCSWCKRVYTL RKDHRTAR | 474 |
| gi\|58616111\|ref\|YP_195802.1\| | PcfP [Enterococcus faecalis] | WSEIEINTKQSN | 475 |
| gi\|58616132\|ref\|YP_195769.1\| | PrgQ [Enterococcus faecalis] | MKTTLKKLSRYIA VVIAITLIFI | 476 |
| gi\|58616137\|ref\|YP_195772.1\| | PrgT [Enterococcus faecalis] | HISKERFEAY | 477 |

TABLE 6-continued

Illustrative bacterial and fungal pheromones utilizable as targeting moieties.

| Bacterial Pheromones Locus tag | Product | Sequence | SEQ ID |
|---|---|---|---|
| gi\|6919848\|sp\|O33689.1\|CSP_STROR | Competence-stimulating peptide precursor (CSP) | DKRLPYFFKHLFSNRTK | 478 |
| gi\|6919849\|sp\|O33666.1\|CSP2_STRMT | Competence-stimulating peptide precursor (CSP) | EMRKPDGALFNLFRRR | 479 |
| gi\|6919850\|sp\|O33668.1\|CSP3_STRMT | Competence-stimulating peptide precursor (CSP) | EMRKSNNNFFHFLRRI | 480 |
| gi\|6919851\|sp\|O33672.1\|CSP1_STRMT | Competence-stimulating peptide precursor (CSP) | ESRLPKIRFDFIFPRKK | 481 |
| gi\|6919852\|sp\|O33675.1\|CSP4_STRMT | Competence-stimulating peptide precursor (CSP) | EIRQTHNIFFNFFKRR | 482 |
| gi\|6919853\|sp\|O33690.1\|CSP2_STROR | Competence-stimulating peptide precursor (CSP) | DWRISETIRNLIFPRK | 483 |
| gi\|999344\|gb\|AAB34501.1\| | cOB1bacterial sex pheromone [*Enterococcus faecalis*, Peptide, 8 aa] | VAVLVLGA | 484 |
| gi\|18307878\|gb\|AAL67734.1\|AF456136_2 | ComX pheromone precursor [*Bacillus subtilis*] | FFEDDKRKSFI | 485 |
| gi\|18307882\|gb\|AAL67737.1\|AF456137_2 | ComX pheromone precursor [*Bacillus subtilis*] | FFEDDKRKSFI | 486 |
| gi\|28272731\|emb\|CAD65660.1\| | accessory gene regulator protein D, peptide pheromone precursor [*Lactobacillus plantarum* WCFS1] | MKQKMYEAIAHLFKYVGAKQLVMCCVGIWFETKIPDELRK | 487 |
| gi\|28379890\|ref\|NP_786782.1\| | accesory gene regulator protein D, peptide pheromone precursor [*Lactobacillus plantarum* WCFS1] | MKQKMYEAIAHLFKYVGAKQLVMCCVGIWFETKIPDELRK | 488 |
| gi\|57489105\|gb\|AAW51312.1\| | PrgF [*Enterococcus faecalis*] | VVAYVITQVGAIRF | 489 |
| gi\|58616090\|ref\|YP_195779.1\| | PrgF [*Enterococcus faecalis*] | VVAYVITQVGAIRF | 490 |
| gi\|58616138\|ref\|YP_195762.1\| | PrgN [*Enterococcus faecalis*] | LLKLQDDYLLHLERHRRTKKIIDEN | 491 |
| gi\|57489117\|gb\|AAW51324.1\| | PcfF [*Enterococcus faecalis*] | EDIKDLTDKVQSLNALVQSELNKLIKRKDQS | 492 |
| gi\|57489119\|gb\|AAW51326.1\| | PcfH [*Enterococcus faecalis*] | WFLDFSDWLSKVPSKLWAE | 493 |
| gi\|58616102\|ref\|YP_195792.1\| | PcfF [*Enterococcus faecalis*] | EDIKDLTDKVQSLNALVQSELNKLIKRKDQS | 494 |
| gi\|58616104\|ref\|YP_195794.1\| | PcfH [*Enterococcus faecalis*] | WFLDFSDWLSKVPSKLWAE | 495 |
| Fungi | | | 496 |
| gi\|1127585\|gb\|AAA99765.1\| | mfa1 gene product | MLSIFAQTTQTSASEPQQSPTAPQGRDNGSPIGYSSCVVA | 497 |
| gi\|1127592\|gb\|AAA99771.1\| | mfa2 gene product | MLSIFETVAAAPVTVAETQQASNNENRGQPGYYCLIA | 498 |

TABLE 6-continued

Illustrative bacterial and fungal pheromones utilizable as targeting moieties.

Bacterial Pheromones

| Locus tag | Product | Sequence | SEQ ID |
|---|---|---|---|
| gi\|11907715\|gb\|AAG41298.1\| | pheromone precursor MFalpha1D [*Cryptococcus neoformans* var. *neoformans*] | PSLPSSPPSLLPPLPL LKLLATRRPTLVG MTLCV | 499 |
| gi\|13810235\|emb\|CAC37424.1\| | M-factor precursor Mfm1 [*Schizosaccharomyces pombe*] | MDSMANSVSSSSV VNAGNKPAETLNK TVKNYTPKVPYMC VIA | 500 |
| gi\|14269436\|gb\|AAK58071.1\|AF378295_1 | peptide mating pheromone precursor Bbp2-3 [*Schizophyllum commune*] | MDTFTYVDLAAVA AAVADEVPRDFE DQITDYQSYCIIC | 501 |
| gi\|14269440\|gb\|AAK58073.1\|AF378297_1 | peptide mating pheromone precursor Bbp2-1 [*Schizophyllum commune*] | SNVHGWCVVA | 502 |
| gi\|1813600\|gb\|AAB41859.1\| | pheromone precursor Bbp1(1) [*Schizophyllum commune*] | NTTAHGWCVVA | 503 |
| gi\|24940428\|emb\|CAD56313.1\| | a-pheromone [*Saccharomyces paradoxus*] | MQPSTVTAAPKDK TSAEKKDNYIIKGV FWDPACVIA | 504 |
| gi\|27549492\|gb\|AAO17258.1\| | pheromone phb3.1 [*Coprinopsis cinerea*] | GPTWWCVNA | 505 |
| gi\|27549494\|gb\|AAO17259.1\| | pheromone phb3.2 [*Coprinopsis cinerea*] | SGPTWFCIIQ | 506 |
| gi\|27752314\|gb\|AAO19469.1\| | pheromone protein a precursor [*Cryptococcus neoformans* var. *grubii*] | FTAIFSTLSSSVASK TDAPRNEEAYSSG NSP | 507 |
| gi\|2865510\|gb\|AAC02682.1\| | MAT-1 pheromone [*Ustilago hordei*] | MFSIFAQPAQTSVS ETQESPANHGANP GKSGSGLGYSTCV VA | 508 |
| gi\|3023372\|sp\|P78742.1\|BB11_SCHCO | RecName: Full = Mating-type pheromone BBP1(1); Flags: Precursor | NTTAHGWCVVA | 509 |
| gi\|3025079\|sp\|P56508.1\|SNA2_YEAST | RecName: Full = Protein SNA2 | SDDNYGSLA | 510 |
| gi\|37626077\|gb\|AAQ96360.1\| | pheromone precursor Phb3 B5 [*Coprinopsis cinerea*] | NGLTFWCVIA | 511 |
| gi\|37626081\|gb\|AAQ96362.1\| | pheromone precursor Phb3.2 B45 [*Coprinopsis cinerea*] | PSWFCVIA | 512 |
| gi\|37626083\|gb\|AAQ96363.1\| | pheromone precursor Phb3.1 B47 [*Coprinopsis cinerea*] | ASWFCTIA | 513 |
| gi\|37961432\|gb\|AAP57503.1\| | Ste3-like pheromone receptor [*Thanatephorus cucumeris*] | PHHKIANASDKRR RMYFEIFMCAVL | 514 |
| gi\|400250\|sp\|P31962.1\|MFA1_USTMA | RecName: Full = A1-specific pheromone; AltName: Full = Mating factor A1 | MLSIFAQTTQTSAS EPQQSPTAPQGRDN GSPIGYSSCVVA | 515 |
| gi\|400251\|sp\|P31963.1\|MFA2_USTMA | RecName: Full = A2-specific pheromone; AltName: Full = Mating factor A2 | MLSIFETVAAAPV TVAETQQASNNEN RGQPGYYCLIA | 516 |

TABLE 6-continued

Illustrative bacterial and fungal pheromones utilizable as targeting moieties.

| Bacterial Pheromones Locus tag | Product | Sequence | SEQ ID |
|---|---|---|---|
| gi\|41209131\|gb\|AAR99617.1\| | lipopeptide mating pheromone precursor Bap2(3) [*Schizophyllum commune*] | SLTYAWCVVA | 517 |
| gi\|41209146\|gb\|AAR99650.1\| | lipopeptide mating pheromone precursor Bap3(2) [*Schizophyllum commune*] | TSMAHAWCVVA | 518 |
| gi\|41209149\|gb\|AAR99653.1\| | lipopeptide mating pheromone precursor Bbp2(8) [*Schizophyllum commune*] | GYCVVA | 519 |
| gi\|46098187\|gb\|EAK83420.1\| | MFA1_USTMA A1-SPECIFIC PHEROMONE (MATING FACTOR A1) [*Ustilago maydis* 521] | MLSIFAQTTQTSAS EPQQSPTAPQGRDN GSPIGYSSCVVA | 520 |
| gi\|546861\|gb\|AAB30833.1\| | M-factor mating pheromone [*Schizosaccharomyces pombe*] | MDSMANTVSSSVV NTGNKPSETLNKT VKNYTPKVPYMCV IA | 521 |
| gi\|5917793\|gb\|AAD56043.1\|AF184069_1 | pheromone Mfa2 [*Ustilago hordei*] | MFSLFETVAAAVK VVSAAEPEHAPTNE GKGEPAPYCIIA | 522 |
| gi\|6014618\|gb\|AAF01424.1\|AF186389_1 | Phb3.2.42 [*Coprinus cinereus*] | LTWFCVIA | 523 |
| gi\|68266363\|gb\|AAY88882.1\| | putative pheromone receptor STE3.4 [*Coprinellus disseminatus*] | LREKRRRRWFEAF MGFGL | 524 |
| gi\|71012805\|ref\|XP_758529.1\| | A1-specific pheromone [*Ustilago maydis* 521] | MLSIFAQTTQTSAS EPQQSPTAPQGRDN GSPIGYSSCVVA | 525 |
| gi\|72414834\|emb\|CAI59748.1\| | mating factor a1.3 [*Sporisorium reilianum*] | MDALTLFAPVSLG AVATEQAPVDEER PNRQTFPWIGCVVA | 526 |
| gi\|72414854\|emb\|CAI59758.1\| | mating factor a2.1 [*Sporisorium reilianum*] | MFIFESVVASVQAV SVAEQDQTPVSEG RGKPAVYCTIA | 527 |
| gi\|1127587\|gb\|AAA99767.1\| | rba1 gene product | PWMSLLFSFLALLA LILPKLSKDDPLGL TRQPR | 528 |
| gi\|151941959\|gb\|EDN60315.1\| | pheromone-regulated membrane protein [*Saccharomyces cerevisiae* YJM789] | ASISLIMEGSANIEA VGKLVWLAAALPL AFI | 529 |
| gi\|3025095\|sp\|Q07549.1\|SNA4_YEAST | Protein SNA4 | ARNVYPSVETPLLQ GAAPHDNKQSLVE SPPPYVP | 530 |
| gi\|73921293\|sp\|Q08245.3\|ZEO1_YEAST | RecName: Full = Protein ZEO1; AltName: Full = Zeocin resistance protein 1 | FLKKLNRKIASIFN | 531 |
| gi\|74644573\|sp\|Q9P305.3\|IGO2_YEAST | RecName: Full = Protein IGO2 | DSISRQGSISSGPPP RSPNK | 532 |

Effectors.

Any of a wide number of effectors can be coupled to targeting moieties as described herein to preferentially deliver the effector to a target organism and/or tissue. Illustrative effectors include, but are not limited to detectable labels, small molecule antibiotics, antimicrobial peptides, porphyrins or other photosensitizers, epitope tags/antibodies for use in a pretargeting protocol, microparticles and/or microcapsules, nanoparticles and/or nanocapsules, "carrier" vehicles including, but not limited to lipids, liposomes, dendrimers, cholic acid-based peptide mimics or other peptide mimics, steroid antibiotics, and the like.

Detectable Labels.

In certain embodiments chimeric moieties are provided comprising a targeting moiety (e.g. as described in Table 2) attached directly or through a linker to a detectable label. Such chimeric moieties are effective for detecting the presence and/or quantity, and/or location of the microorganism(s) to which the targeting moiety is directed. Similarly these chimeric moieties are useful to identify cells and/or tissues and/or food stuffs and/or other compositions that are infected with the targeted microorganism(s).

Detectable labels suitable for use in such chimeric moieties include any composition detectable by spectroscopic, photochemical, biochemical, immunochemical, electrical, optical, or chemical means. Illustrative useful labels include, but are not limited to, biotin for staining with labeled streptavidin conjugates, avidin or streptavidin for labeling with biotin conjugates fluorescent dyes (e.g., fluorescein, texas red, rhodamine, green fluorescent protein, and the like, see, e.g., Molecular Probes, Eugene, Oreg., USA), radiolabels (e.g., $^{3}$H, $^{125}$I, $^{35}$S, $^{14}$C, $^{32}$P, $^{99}$Tc, $^{203}$Pb, $^{67}$Ga, $^{68}$Ga, $^{72}$As, $^{111}$In, $^{113m}$In, $^{97}$Ru, $^{62}$Cu, $^{64}$Cu, $^{52}$Fe, $^{52m}$Mn, $^{51}$Cr, $^{186}$Re, $^{188}$Re, $^{77}$As, $^{90}$Y, $^{67}$Cu, $^{169}$Er, $^{121}$Sn, $^{127}$Te, $^{142}$Pr, $^{143}$Pr, $^{198}$Au, $^{199}$Au, $^{161}$Tb, $^{109}$Pd, $^{165}$Dy, $^{149}$Pm, $^{151}$Pm, $^{153}$Sm, $^{157}$Gd, $^{159}$Gd, $^{166}$Ho, $^{172}$Tm, $^{169}$Yb, $^{177}$Lu, $^{105}$Rh, $^{111}$Ag, and the like), enzymes (e.g., horse radish peroxidase, alkaline phosphatase and others commonly used in an ELISA), various colorimetric labels, magnetic or paramagnetic labels (e.g., magnetic and/or paramagnetic nanoparticles), spin labels, radio-opaque labels, and the like. Patents teaching the use of such labels include, for example, U.S. Pat. Nos. 3,817,837; 3,850,752; 3,939,350; 3,996,345; 4,277,437; 4,275,149; and 4,366,241.

It will be recognized that fluorescent labels are not to be limited to single species organic molecules, but include inorganic molecules, multi-molecular mixtures of organic and/or inorganic molecules, crystals, heteropolymers, and the like. Thus, for example, CdSe—CdS core-shell nanocrystals enclosed in a silica shell can be easily derivatized for coupling to a biological molecule (Bruchez et al. (1998) Science, 281: 2013-2016). Similarly, highly fluorescent quantum dots (zinc sulfide-capped cadmium selenide) have been covalently coupled to biomolecules for use in ultrasensitive biological detection (Warren and Nie (1998) Science, 281: 2016-2018).

In various embodiments spin labels are provided by reporter molecules with an unpaired electron spin which can be detected by electron spin resonance (ESR) spectroscopy. Illustrative spin labels include organic free radicals, transitional metal complexes, particularly vanadium, copper, iron, and manganese, and the like. Exemplary spin labels include, for example, nitroxide free radicals.

Means of detecting such labels are well known to those of skill in the art. Thus, for example, where the label is a radioactive label, means for detection include a scintillation counter or photographic film as in autoradiography. Where the label is a fluorescent label, it may be detected by exciting the fluorochrome with the appropriate wavelength of light and detecting the resulting fluorescence, e.g., by microscopy, visual inspection, via photographic film, by the use of electronic detectors such as charge coupled devices (CCDs) or photomultipliers and the like. Similarly, enzymatic labels may be detected by providing appropriate substrates for the enzyme and detecting the resulting reaction product. Finally, simple colorimetric labels may be detected simply by observing the color associated with the label.

Antibiotics.

In certain embodiments chimeric moieties are provided comprising a targeting moiety (e.g. as described in Table 2) attached directly or through a linker to a small molecule antibiotic and/or to a carrier (e.g., a lipid or liposome, a polymer, etc.) comprising a small molecule antibiotic (e.g., an antibiotics shown in Table 7).

TABLE 7

Illustrative antibiotics for use in the chimeric moieties described herein.

| Class | Generic Name | Brand Name |
|---|---|---|
| Aminoglycosides | Amikacin | Amikin |
| | Gentamicin | Garamycin |
| | Kanamycin | Kantrex |
| | Neomycin | |
| | Netilmicin | Netromycin |
| | Streptomycin | |
| | Tobramycin | Nebcin |
| | Paromomycin | Humatin |
| Carbacephem | Loracarbef | Lorabid |
| Carbapenems | Ertapenem | Invanz |
| | Doripenem | Finibax |
| | Imipenem/Cilastatin | Primaxin |
| | Meropenem | Merrem |
| Cephalosporins (First generation) | Cefadroxil | Duricef |
| | Cefazolin | Ancef |
| | Cefalotin or Cefalothin | Keflin |
| | Cefalexin | Keflex |
| Cephalosporins (Second generation) | Cefaclor | Ceclor |
| | Cefamandole | Mandole |
| | Cefoxitin | Mefoxin |
| | Cefprozil | Cefzil |
| | Cefuroxime | Ceftin, Zinnat |
| Cephalosporins (Third generation) | Cefixime | Suprax |
| | Cefdinir | Omnicef |
| | Cefditoren | Spectracef |
| | Cefoperazone | Cefobid |
| | Cefotaxime | Claforan |
| | Cefpodoxime | |
| | Ceftazidime | Fortaz |
| | Ceftibuten | Cedax |
| | Ceftizoxime | |
| | Ceftriaxone | Rocephin |
| Cephalosporins (Fourth generation) | Cefepime | Maxipime |
| Cephalosporins (Fifth generation) | Ceftobiprole | |
| Glycopeptides | Teicoplanin | |
| | Vancomycin | Vancocin |
| Macrolides | Azithromycin | Zithromax |
| | Clarithromycin | Biaxin |
| | Dirithromycin | |
| | Erythromycin | Erythocin, Erythroped |
| | Roxithromycin | |
| | Troleandomycin | |
| | Telithromycin | Ketek |
| Monobactams | Aztreonam | |
| Penicillins | Amoxicillin | Novamox, Amoxil |
| | Ampicillin | |
| | Azlocillin | |
| | Carbenicillin | |
| | Cloxacillin | |

TABLE 7-continued

Illustrative antibiotics for use in the chimeric moieties described herein.

| Class | Generic Name | Brand Name |
|---|---|---|
| | Dicloxacillin | |
| | Flucloxacillin | Floxapen |
| | Mezlocillin | |
| | Meticillin | |
| | Nafcillin | |
| | Oxacillin | |
| | Penicillin | |
| | Piperacillin | |
| | Ticarcillin | |
| Polypeptides | Bacitracin | |
| | Colistin | |
| | Polymyxin B | |
| Quinolones | Mafenide | |
| | Prontosil (archaic) | |
| | Sulfacetamide | |
| | Sulfamethizole | |
| | Sulfanilimide (archaic) | |
| | Sulfasalazine | |
| | Sulfisoxazole | |
| | Trimethoprim Trimethoprim-Sulfamethoxazole (Cotrimoxazole) (TMP-SMX) | Bactrim |
| Tetracyclines | Demeclocycline | |
| | Doxycycline | Vibramycin |
| | Minocycline | Minocin |
| | Oxytetracycline | Terracin |
| | Tetracycline | Sumycin |
| Cationic steroid antibiotics | squalamine | |
| | CSA-8 | |
| | CSA-11 | |
| | CSA-13 | |
| | CSA-15 | |
| | CSA-25 | |
| | CSA-46 | |
| | CSA-54 | |
| | CSA-90 | |
| | CSA-97 | |
| Others | Arsphenamine | Salvarsan |
| | Chloramphenicol | Chloromycetin |
| | Clindamycin | Cleocin |
| | Lincomycin | |
| | Ethambutol | |
| | Fosfomycin | |
| | Fusidic acid | Fucidin |
| | Furazolidone | |
| | Isoniazid | |
| | Linezolid | Zyvox |
| | Metronidazole | Flagyl |
| | Mupirocin | Bactroban |
| | Nitrofurantoin | Macrodantin, Macrobid |
| | Platensimycin | |
| | Pyrazinamide | |
| | Quinupristin/Dalfopristin | Syncercid |
| | Rifampin or Rifampicin | |
| | Tinidazole | |

Porphyrins and Non-Porphyrin Photosensitizers.

In certain embodiments, porphyrins and other photosensitizers can be used as targeting moieties and/or as effectors in the methods and compositions of this invention. A photosensitizer is a drug or other chemical that increases photosensitivity of the organism (e.g., bacterium, yeast, fungus, etc.). As targeting moieties the photosensitizers (e.g., porphyrins) are preferentially uptaken by the target microorganisms and thereby facilitate delivery of the chimeric moiety to the target microorganism.

As effectors, photosensitizers can be useful in photodynamic antimicrobial chemotherapy (PACT). In various embodiments PACT utilizes photosensitizers and light (e.g., visible, ultraviolet, infrared, etc.) in order to give a phototoxic response in the target organism(s), often via oxidative damage.

Currently, the major use of PACT is in the disinfection of blood products, particularly for viral inactivation, although more clinically-based protocols are used, e.g. in the treatment of oral infection or topical infection. The technique has been shown to be effective in vitro against bacteria (including drug-resistant strains), yeasts, viruses, parasites, and the like.

Attaching a targeting moiety (e.g., a targeting peptide as shown in Table 2) to the photosensitizer, e.g., as described herein, provides a means of specifically or preferentially targeting the photosensitizer(s) to particular species or strains(s) of microorganism.

A wide range of photosensitizers, both natural and synthetic are known to those of skill in the art (see, e.g., Wainwright (1998) *J. Antimicrob. Chemotherap.* 42: 13-28). Photosensitizers are available with differing physicochemical make-up and light-absorption properties. In various embodiments photosensitizers are usually aromatic molecules that are efficient in the formation of long-lived triplet excited states. In terms of the energy absorbed by the aromatic-system, this again depends on the molecular structure involved. For example: furocoumarin photosensitizers (psoralens) absorb relatively high energy ultraviolet (UV) light (c. 300-350 nm), whereas macrocyclic, heteroaromatic molecules such as the phthalocyanines absorb lower energy, near-infrared light.

Illustrative photosensitizers include, but are not limited to porphyrinic macrocyles (especially porphyrins, chlorines, etc., see, e.g., FIGS. 1 and 2). In particular, metalloporphyrins, particularly a number of non-iron metalloporphyrins mimic heme in their molecular structure and are actively accumulated by bacteria via high affinity heme-uptake systems. The same uptake systems can be used to deliver antibiotic-porphyrin and antibacterial-porphyrin conjugates. Illustrative targeting porphyrins suitable for this purpose are described in U.S. Pat. No. 6,066,628 and shown herein in FIGS. 1 and 2.

For example, certain artificial (non-iron) metalloporphyrins (MPs) (Ga-IX, Mn-IX,) are active against Gram-negative and Gram-positive bacteria and acid-fast bacilli (e.g., *Y. enterocolitica, N. meningitides, S. marcescens, E. coli, P. mirabilis, K. pneumoniae, K. oxytoca, Ps. aeruginosa, C. freundii, E. aerogenes, F. menigosepticum, S. aureus, B. subtilis, S. pyogenes A, E. faecalis, M. smegmatis, M. bovis, M. tuber., S. cerevisiae*) as described in Tables 1-5 of U.S. Pat. No. 6,066,628. These MPs can be used as targeting moieties against these microorganisms.

Similarly, some MPs are also growth-inhibitory against yeasts, indicating their usefulness targeting moieties to target *Candida* species (e.g., *Candida albicans, C. krusei, C. pillosus, C. glabrata*, etc.) and other mycoses including but not limited to those caused by as *Trichophyton, Epidermophyton, Histoplasma, Aspergillus, Cryptococcus*, and the like.

Other photosensitizers include, but are not limited to cyanines (see, e.g., FIG. 6) and phthalocyanines (see, e.g., FIG. 4), azines (see, e.g., FIG. 5) including especially methylene blue and toluidine blue, hypericin (see, e.g., FIG. 8), acridines (see, e.g., FIG. 9) including especially Rose Bengal (see, e.g., FIG. 10), crown ethers (see, e.g., FIG. 11), and the like.

In certain embodiments the photosensitizers are toxic or growth inhibitors without light activation. For example, some non-iron metalloporphyrins (MPs) (see, e.g., FIGS. 1 and 2 herein) possess a powerful light-independent antimicrobial activity. In addition, haemin, the most well known natural porphyrin, possesses a significant antibacterial activity that can augmented by the presence of physiological concentrations of hydrogen peroxide or a reducing agent.

Typically, when activated by light, the toxicity or growth inhibition effect is substantially increased. Typically, they generate radical species that affect anything within proximity. In certain embodiments to get the best selectivity from targeted photosensitizers, anti-oxidants can be used to quench un-bound photosensitizers, limiting the damage only to cells where the conjugates have accumulated due to the targeting peptide. The membrane structures of the target cell act as the proton donors in this case.

In typical photodynamic antimicrobial chemotherapy (PACT) the targeted photosensitizer is "activated by the application of a light source (e.g., a visible light source, an ultraviolet light source, an infrared light source, etc.). PACT applications however need not be limited to topical use. Regions of the mouth, throat, nose, sinuses are readily illuminated. Similarly regions of the gut can readily be illuminated using endoscopic techniques. Other internal regions can be illumined using laparoscopic methods or during other surgical procedures. For example, in certain embodiments involving the insertion or repair or replacement of an implantable device (e.g., a prosthetic device) it contemplated that the device can be coated or otherwise contacted with a chimeric moiety comprising a targeting moiety attached to a photosensitizer as described herein. During the surgical procedure and/or just before closing, the device can be illuminated with an appropriate light source to activate the photosensitizer.

The targeted photosensitizers and uses thereof described herein are illustrative and not to be limiting. Using the teachings provided herein, other targeted photosensitizers and uses thereof will be available to one of skill in the art.

Antimicrobial Peptides.

In certain embodiments the chimeric moieties described herein include one or more antimicrobial peptides (e.g., certain peptides shown in Table 2 and/or Table 10) as effectors. Thus, for example, in certain embodiments, where the peptides described in Table 2 are exploited for their targeting ability, chimeric moieties are contemplated comprising one or more of the targeting peptides of Table 2 attached to one or more of the antimicrobial peptides of Table 10. In certain embodiments chimeric moieties are contemplated comprising one or more of the targeting peptides of Table 2 attached to one or more of the antimicrobial peptides of Table 2. In certain embodiments chimeric moieties are contemplated comprising other targeting moieties (e.g., porphyrins, antibodies, etc.) attached to one or more of the antimicrobial peptides of Table 2.

Antimicrobial peptides (also called host defense peptides) are an evolutionarily conserved component of the innate immune response and are found among all classes of life. Unmodified, these peptides are potent, broad spectrum antibiotics which demonstrate potential as novel therapeutic agents. Antimicrobial peptides have been demonstrated to kill Gram-negative and Gram-positive bacteria (including strains that are resistant to conventional antibiotics), mycobacteria (including *Mycobacterium tuberculosis*), enveloped viruses, and fungi.

Naturally-occurring antimicrobial peptides are typically short peptides, generally between 12 and 50 amino acids. These peptides often include two or more positively charged residues provided by arginine, lysine or, in acidic environments, histidine, and frequently a large proportion (generally >50%) of hydrophobic residues (see, e.g., Papagianni et al. (2003) *Biotechnol Adv* 21: 465; Sitaram and Nagaraj (2002) *Curr Pharm Des* 8: 727; Dürr et al. (2006) *Biochim. Biophys. Acta* 1758: 1408-1425).

Frequently the secondary structures of these molecules follow 4 themes, including i) α-helical, ii) β-stranded due to the presence of 2 or more disulfide bonds, iii) β-hairpin or loop due to the presence of a single disulfide bond and/or cyclization of the peptide chain, and iv) extended. Many of these peptides are unstructured in free solution, and fold into their final configuration upon partitioning into biological membranes. The ability to associate with membranes is a definitive feature of antimicrobial peptides although membrane permeabilisation is not necessary. These peptides have a variety of antimicrobial activities ranging from membrane permeabilization to action on a range of cytoplasmic targets.

The modes of action by which antimicrobial peptides kill bacteria is varied and includes, but is not limited to disrupting membranes, interfering with metabolism, and targeting cytoplasmic components. In many cases the exact mechanism of killing is not known.

In various embodiments one or more antimicrobial peptides are used alone (e.g., as broad spectrum antimicrobials) and/or are provided as effectors attached to one or more targeting moieties thereby providing a narrower spectrum (directed) antimicrobial. In certain embodiments one or more antimicrobial peptides are provided as effectors attached to one or more targeting moieties and/or one or more effectors thereby providing a component of a multiple effector composition/strategy.

Suitable antimicrobial peptides for this use include, but are not limited to the antimicrobial peptides found in Table 2, and/or Table 9, and/or Table 10.

TABLE 8

Novel antimicrobial peptides.

| ID | Structure/sequence | SEQ ID NO |
|---|---|---|
| K-1 | GLGRVIGRLIKQIIWRR | 533 |
| K-2 | VYRKRKSILKIYAKLKGWH | 534 |
| K-3 | AFYQRKENVISLDPREWLGFNVTEK | 535 |
| K-4 | DKKRVIERIKSFSLRDEVIHFGELCIYWGK | 536 |
| K-5 | RSSYNGFSKICFLKIEHFGSYSYQGR | 537 |
| K-6 | WLNAISLYGRIG | 538 |
| K-7 | NYRLVNAIFSKIFKKKFIKF | 539 |
| K-8 | KIL K FLF K KVF | 540 |
| K-9 | FI RK FLK KW LL | 541 |
| K-10 | KLFKFLRKHLL | 542 |
| K-11 | KIL K FLF K QVF | 543 |
| K-12 | KIL K KLF K FVF | 544 |
| K-13 | GIL K KLF T KVF | 545 |
| K-14 | L R K FL H K LF | 546 |
| K-15 | L R KNL R WLF | 547 |
| K-16 | FI RK FLQ KLHL | 548 |
| K-17 | FTRKFLKFLHL | 549 |
| K-18 | KKFKKFKVLKIL | 550 |
| K-19 | LLKLLKLKKLKF | 551 |

In certain embodiments peptides that induce alterations in phenotype or other biological activities can also be used as antimicrobial effector moieties. Illustrative alternative peptides are shown in Table 9.

TABLE 9

Novel growth phenotype-inducing or peptides with other activities.

| ID | Organism, effect | Structure/sequence | SEQ ID NO |
|---|---|---|---|
| G-1 | S. mutans: Ca2+ bindng | DSSQSDSDSDSNSSNTNSNSSITNG | 552 |
| G-2 | S. mutans: biofilm structure | LPGTLHIQAEFPVQLEAGSLIQIFD | 553 |
| G-3 | S. mutans: biofilm structure | LACTTPVGAVLYLGAEVCAGAAVIYYGAN | 554 |
| G-4 | S. mutans: Biofilm structure | EIPIQLANDLANYYDISLDSIFFW | 555 |
| G-5 | M. xanthus: Altered cell morphology | RDMTVAGKRPNFLIITTDEE | 556 |
| G-6 | M. xanthus: Altered cell morphology | NTSIVCAVTFAPIKEVPLLWRAGLTLRSRQS | 557 |
| G-7 | M. xanthus: Altered cell morphology | QAKVEREVERDLVYTLRRLCDPSGSERTK | 558 |
| G-8 | S. mutans: Altered biofilm structure | PRMIDIISFHGCHGDHQVWTDPQATALPR | 559 |

Other illustrative antimicrobial peptides include, but are not limited to the AMPs of Table 10.

TABLE 10

Other illustrative antimicrobial peptides. AP numbers refer to ID in antimicrobial peptide database (aps.unmc.edu/AP/main.php).

| | Effector | Structure/Sequence | SEQ ID No |
|---|---|---|---|
| AP00274 | 1BH4, Circulin A (CirA, plant cyclotides, XXC, ZZHp) | GIPCGESCVWIPCISAALGCSCKNKVCYRN | 560 |
| AP00036 | 1BNB, Beta-defensin 1 (cow) | DFASCHTNGGICLPNRCPGHMIQIGICFRPRVKCCRSW | 561 |
| AP00047 | 1BNB, Bovine neutrophil beta-defensin 12 (BNBD-12, cow) | GPLSCGRNGGVCIPIRCPVPMRQIGTCFGRPVKCCRSW | 562 |
| AP00428 | 1C01, MiAMP1 (Macadamia integrifolia antimicrobial peptide 1, plant) | SAFTVWSGPGCNNRAERYSKCGCSAIHQKGGYDFSYTGQTAALYNQAGCSGVAHTRFGSSARACNPFGWKSIFIQC | 563 |
| AP00154 | 1CIX, Tachystatin A2 (Horseshoe crabs, Crustacea, BBS) | YSRCQLQGFNCVVRSYGLPTIPCCRGLTCRSYFPGSTYGRCQRY | 564 |
| AP00145 | 1CW5, Carnobacteriocin B2 (CnbB2, class IIA bacteriocin, bacteria) | VNYGNGVSCSKTKCSVNWGQAFQERYTAGINSFVSGVASGAGSIGRRP | 565 |
| AP00153 | 1CZ6, Androctonin (scorpions) | RSVCRQIKICRRRGGCYYKCTNRPY | 566 |
| AP00152 | 1D6X, Tritrpticin (synthetic) | VRRFPWWWPFLRR | 567 |
| AP00201 | 1D7N, Mastoparan (insect) | INLKALAALAKKIL | 568 |
| AP00140 | 1D9J, CecropinA-Magainin2 hybrid (synthetic) | KWKLFKKIGIGKFLHSAKKF | 569 |
| AP00178 | 1DFN, human alpha Defensin HNP-3 (human neutrophil peptide-3, HNP3, human defensin, ZZHh) | DCYCRIPACIAGERRYGTCIYQGRLWAFCC | 570 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP01153 1DQC, Tachycitin (horseshoe crabs, *Crustacea*, BBS) | YLAFRCGRYSPCLDDGPNVNLYSCCS FYNCHKCLARLENCPKGLHYNAYLK VCDWPSKAGCT | 571 |
| AP00437 1DUM, Magainin 2 analog (synthetic) | GIGKYLHSAKKFGKAWVGEIMNS | 572 |
| AP00451 1E4S, Human beta defensin 1 (HBD-1, human defensin) | DHYNCVSSGGQCLYSACPIFTKIQGTC YRGKAKCCK | 573 |
| AP00149 1EWS, Rabbit kidney defensin 1 (RK-1) | MPCSCKKYCDPWEVIDGSCGLFNSKY ICCREK | 574 |
| AP00141 1F0E, CecropinA-Magainin2 Hybrid (P18, synthetic) | KWKLFKKIPKFLHSAKKF | 575 |
| AP00142 1F0G, CecropinA-Magainin2 Hybrid (synthetic) | KLKLFKKIGIGKFLHSAKKF | 576 |
| AP00143 1F0H, CecropinA-Magainin2 Hybrid (synthetic) | KAKLFKKIGIGKFLHSAKKF | 577 |
| AP00524 1FD4, Human beta defensin 2 (HBD-2, human defensin, ZZHh) | GIGDPVTCLKSGAICHPVFCPRRYKQI GTCGLPGTKCCKKP | 578 |
| AP00438 1FJN, Mussel Defensin MGD-1 | GFGCPNNYQCHRHCKSIPGRCGGYCG GWHRLPCTCYRCG | 579 |
| AP00155 1FRY, SMAP-29 (SMAP29, sheep cathelicidin) | RGLRRLGRKIAHGVKKYGPTVLRIIRI AG | 580 |
| AP00150 1G89, Indolicidin (cow cathelicidin, BBN, ZZHa) | ILPWKWPWWPWRR | 581 |
| AP00156 1GR4, Microcin J25, linear (MccJ25, bacteriocin, bacteria) | VGIGTPISFYGGGAGHVPEYF | 582 |
| AP00151 1HR1, Indolicidin P to A mutant (synthetic) | ILAWKWAWWAWRR | 583 |
| AP00196 1HU5, Ovispirin-1 (synthetic) | KNLRRIIRKIIHIIKKYG | 584 |
| AP00197 1HU6, Novispirin G10 (synthetic) | KNLRRIIRKGIHIIKKYG | 585 |
| AP00198 1HU7, Novispirin T7 (synthetic) | KNLRRITRKIIHIIKKYG | 586 |
| AP00445 1HVZ, Monkey RTD-1 (rhesus theta-defensin-1, minidefensin-1, animal defensin, XXC, BBS, lectin, ZZHa) | GFCRCLCRRGVCRCICTR | 587 |
| AP00103 1i2v, Heliomicin variant (Hel-LL, synthetic) | DKLIGSCVWGAVNYTSDCNGECLLRG YKGGHCGSFANVNCWCET | 588 |
| AP00216 1ICA, Phormia defensin A (insect defensin A) | ATCDLLSGTGINHSACAAHCLLRGNR GGYCNGKGVCVCRN | 589 |
| AP01224 1Jo3, Gramicidin B (bacteria) | VGALAVVVWLFLWLW | 590 |
| AP01225 1jo4, Gramicidin C (bacteria) | VGALAVVVWLYLWLW | 591 |

TABLE 10-continued

Other illustrative antimicrobial peptides. AP numbers refer to ID in antimicrobial peptide database (aps.unmc.edu/AP/main.php).

| | Effector | Structure/Sequence | SEQ ID No |
|---|---|---|---|
| AP00191 | 1KFP, Gomesin (Gm, Spider, XXA) | ECRRLCYKQRCVTYCRGR | 592 |
| AP00283 | 1KJ6, Huamn beta defensin 3 (HBD-3, human defensin, ZZHh) | GIINTLQKYYCRVRGGRCAVLSCLPKE EQIGKCSTRGRKCCRRKK | 593 |
| AP00147 | 1KV4, Moricin (insect, silk moth) | AKIPIKAIKTVGKAVGKGLRAINIASTA NDVFNFLKPKKRKA | 594 |
| AP00227 | 1L4V, Sapecin (insect, flesh fly) | ATCDLLSGTGINHSACAAHCLLRGNR GGYCNGKAVCVCRN | 595 |
| AP01161 | 1L9L, Human granulysin (huGran) | GRDYRTCLTIVQKLKKMVDKPTQRSV SNAATRVCTRGRSRWRDVCRNFMRR YQSRVIQGLVAGETAQQICEDLRLCIP STGPL | 596 |
| AP00026 | 1LFC, Lactoferricin B (LfcinB, cow, ZZHa) | FKCRRWQWRMKKLGAPSITCVRRAF | 597 |
| AP00193 | 1M4F, human LEAP-1 (Hepcidin 25) | DTHFPICIFCCGCCHRSKCGMCCKT | 598 |
| AP00499 | 1MAG, Gramicidin A (gA, bacteria) | VGALAVVVWLWLWLW | 599 |
| AP00403 | 1MM0, Termicin (termite defensin, insect defensin) | ACNFQSCWATCQAQHSIYFRRAFCDR SQCKCVFVRG | 600 |
| AP00194 | 1MMC, Ac-AMP2 (plant defensin, BBS) | VGECVRGRCPSGMCCSQFGYCGKGP KYCGR | 601 |
| AP01206 | 1MQZ, Mersacidin (bacteria) | CTFTLPGGGGVCTLTSECIC | 602 |
| AP00429 | 1NKL, Porcine NK-Lysin (pig) | GYFCESCRKIIQKLEDMVGPQPNEDTV TQAASQVCDKLKILRGLCKKIMRSFL RRISWDILTGKKPQAICVDIKICKE | 603 |
| AP00633 | log7, Sakacin P/ Sakacin 674 (SakP, class IIA bacteriocin, bacteria) | KYYGNGVHCGKHSCTVDWGTAIGNI GNNAAANWATGGNAGWNK | 604 |
| AP00195 | 1PG1, Protegrin 1 (Protegrin-1, PG-1, pig cathelicidin, XXA, ZZHa, BBBm) | RGGRLCYCRRRFCVCVGR | 605 |
| AP00928 | 1PXQ, Subtilosin A (XXC, class I bacteriocin, Gram-positive bacteria) | NKGCATCSIGAACLVDGPIPDFEIAGA TGLFGLWG | 606 |
| AP00480 | 1Q71, Microcin J25 (cyclic MccJ25, class I microcins, bacteriocins, Gram-negative bacteria, XXC; BBP) | VGIGTPIFSYGGGAGHVPEYF | 607 |
| AP00211 | 1RKK, Polyphemusin I (crabs, *Crustacea*) | RRWCFRVCYRGFCYRKCR | 608 |
| AP00430 | 1T51, IsCT (Scorpion) | ILGKIWEGIKSLF | 609 |
| AP00731 | 1ut3, Spheniscin-2 (Sphe-2, penguin defensin, avian defensin) | SFGLCRLRRGFCARGRCRFPSIPIGRCS RFVQCCRRVW | 610 |

TABLE 10-continued

Other illustrative antimicrobial peptides. AP numbers refer to ID in antimicrobial peptide database (aps.unmc.edu/AP/main.php).

| Effector | | Structure/Sequence | SEQ ID No |
|---|---|---|---|
| AP00013 | 1VM5, Aurein 1.2 (frog) | GLFDIIKKIAESF | 611 |
| AP00214 | 1WO1, Tachyplesin I (crabs, *Crustacea*, XXA, ZZHa) | KWCFRVCYRGICYRRCR | 612 |
| AP00644 | 1xc0, Pardaxin 4 (Pardaxin P-4, Pardaxin P4, Pa4, flat fish) | GFFALIPKIISSPLFKTLLSAVGSALSSS GGQE | 613 |
| AP00493 | 1XKM, Distinctin (two chains for stability and transport? frog) | NLVSGLIEARKYLEQLHRKLKNCKV | 614 |
| AP00420 | 1XV3, Penaeidin-4d (penaeidin 4, shrimp, *Crustacea*) | HSSGYTRPLRKPSRPIFIRPIGCDVCYGI PSSTARLCCFRYGDCCHL | 615 |
| AP00035 | 1YTR, Plantaricin A (PlnA, bacteriocin, bacteria) | KSSAYSLQMGATAIKQVKKLFKKWGW | 616 |
| AP00166 | 1Z64, Pleurocidin (fish) | GWGSFFKKAAHVGKHVGKAALTHYL | 617 |
| AP00780 | 1Z6V, Human lactoferricin | GRRRRSVQWCAVSQPEATKCFQWQR NMRKVRGPPVSCIKRDSPIQCIQA | 618 |
| AP00549 | 1ZFU, Plectasin (fungi, fungal defensin) | GFGCNGPWDEDDMQCHNHCKSIKGY KGGYCAKGGFVCKCY | 619 |
| AP00177 | 1ZMH, human alpha Defensin HNP-2 (human neutrophil peptide-2, HNP2, human defensin, ZZHh) | CYCRIPACIAGERRYGTCIYQGRLWAF CC | 620 |
| AP00179 | 1ZMM, human alpha Defensin HNP-4 (human neutrophil peptide-4, HNP4, human defensin) | VCSCRLVFCRRTELRVGNCLIGGVSFT YCCTRVD | 621 |
| AP00180 | 1ZMP, human alpha Defensin HD-5 (HD5, human defensin) | QARATCYCRTGRCATRESLSGVCEISG RLYRLCCR | 622 |
| AP00181 | 1ZMQ, human alpha Defensin HD-6 (HD6, human defensin) | STRAFTCHCRRSCYSTEYSYGTCTVM GINHRFCCL | 623 |
| AP00399 | 1ZRW, Spinigerin (insect, termite) | HVDKKVADKVLLLKQLRIMRLLTRL | 624 |
| AP01157 | 1ZRX, Stomoxyn (insect) | RGFRKHFNKLVKKVKHTISETAHVAK DTAVIAGSGAAVVAAT | 625 |
| AP00637 | 2A2B, Curvacin A/ sakacin A (CurA, SakA, class IIA bacteriocin, bacteria) | ARSYGNGVYCNNKKCWVNRGEATQS IIGGMISGWASGLAGM | 626 |
| AP00558 | 2B68, Cg-Def (*Crassostrea gigas* defensin, oyster defensin, animal defensin) | GFGCPGNQLKCNNHCKSISCRAGYCD AATLWLRCTCTDCNGKK | 627 |
| AP01154 | 2B9K, LCI (bacteria) | AIKLVQSPNGNFAASFVLDGTKWIFKS KYYDSSKGYWVGIYEVWDRK | 628 |
| AP01005 | 2DCV, Tachystatin B1 (BBS, horseshoe crabs) | YVSCLFRGARCRVYSGRSCCFGYYCR RDFPGSIFGTCSRRNF | 629 |

TABLE 10-continued

Other illustrative antimicrobial peptides. AP numbers refer to ID in antimicrobial peptide database (aps.unmc.edu/AP/main.php).

| | Effector | Structure/Sequence | SEQ ID No |
|---|---|---|---|
| AP01006 | 2DCW, Tachystatin B1 (BBS, horseshoe crabs) | YITCLFRGARCRVYSGRSCCFGYYCR RDFPGSIFGTCSRRNF | 630 |
| AP00275 | 2ERI, Circulin B (CirB, plant cyclotides, XXC, ZZHp) | CGESCVFIPCISTLLGCSCKNKVCYRN GVIP | 631 |
| AP00707 | 2f3a, LLAA (LL-37-derived aurein 1.2 analog, retro-FK13, synthetic) | RLFDKIRQVIRKF | 632 |
| AP00708 | 2fbs, FK-13 (FK13, NMR-discovered LL-37 core peptide, XXA, ZZHs, synthetic) | FKRIVQRIKDFLR | 633 |
| AP00088 | 2G9L, Gaegurin-4 (Gaegurin 4, frog) | GILDTLKQFAKGVGKDLVKGAAQGV LSTVSCKLAKTC | 634 |
| AP01011 | 2G9P, Latarcin 2a (Ltc2a, BBM, spider) | GLFGKLIKKFGRKAISYAVKKARGKH | 635 |
| AP00612 | 2GDL, Fowlicidin-2 (chCATH-2, bird cathelicidin, chicken cathelicidin, BBL) | LVQRGRFGRFLRKIRRFRPKVTITIQGS ARFG | 636 |
| AP00402 | 2GL1, VrD2 (Vigna radiata defensin 2, plant defensin, mung bean) | KTCENLANTYRGPCFTTGSCDDHCKN KEHLRSGRCRDDFRCWCTRNC | 637 |
| AP00285 | 2GW9, Cryptdin-4 (Crp4, animal defensin, alpha, mouse) | GLLCYCRKGHCKRGERVRGTCGIRFL YCCPRR | 638 |
| AP00613 | 2hfr, Fowlicidin-3 (chCATH-3, bird cathelicidin, chicken cathelicidin) | RVKRFWPLVPVAINTVAAGINLYKAI RRK | 639 |
| AP01007 | 2JMY, CM15 (Synthetic) | KWKLFKKIGAVLKVL | 640 |
| AP00728 | 2jni, Arenicin-2 (marine polychaeta, BBBm) | RWCVYAYVRIRGVLVRYRRCW | 641 |
| AP00473 | 2jos, Piscidin 1 (fish) | FFHHIFRGIVHVGKTIHRLVTG | 642 |
| AP01151 | 2JPJ, Lactococcin G-a (chain a, class IIb bacteriocin, bacteria. For chain b, see info) | GTWDDIGQGIGRVAYWVGKALGNLS DVNQASRINRKKKH | 643 |
| AP00757 | 2jpy, Phylloseptin-H2 (PLS-H2, Phylloseptin-2, PS-2) (XXA, frog) | FLSLIPHAINAVSTLVHHF | 644 |
| AP00546 | 2jq0, Phylloseptin-1 (Phylloseptin-H1, PLS-H1, PS-1, XXA, frog) | FLSLIPHAINAVSAIAKHN | 645 |
| AP00758 | 2jq1, Phylloseptin-3 (Phylloseptin-H3, PLS-H3, PS-3) (XXA, frog) | FLSLIPHAINAVSALANHG | 646 |
| AP00727 | 2jsb, Arenicin-1 (marine polychaeta, BBBm) | RWCVYAYVRVRGVLVRYRRCW | 647 |
| AP00592 | 2k10, Ranatuerin-2CSa (frog) | GILSSFKGVAKGVAKDLAGKLLETLK CKITGC | 648 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00485 2K38, Cupiennin 1a (spider) | GFGALFKFLAKKVAKTVAKQAAKQG AKYVVNKQME | 649 |
| AP00310 2K6O, Human LL-37 (LL37, human cathelicidin; released by proteinase 3 from its precursor in neutrophils; FALL-39; BBB, BBM, BBP, BBW, BBD, BBL, ZZHh) | LLGDFFRKSKEKIGKEFKRIVQRIKDFL RNLVPRTES | 650 |
| AP00199 2LEU, Leucocin A (LeuA, class IIa bacteriocin, bacteria) | KYYGNGVHCTKSGCSVNWGEAFSAG VHRLANGGNGFW | 651 |
| AP00144 2MAG, Magainin 2 (frog) | GIGKFLHSAKKFGKAFVGEIMNS | 652 |
| AP00146 2MLT, Melittin (insect, ZZHa) | GIGAVLKVLTTGLPALISWIKRKRQQ | 653 |
| AP01010 2PCO, Latarcin 1 (Ltc1, BBM, spider) | SMWSGMWRRKLKKLRNALKKKLKG EK | 654 |
| AP00176 2PM1, human alpha Defensin HNP-1 (human neutrophil peptide-1, HNP1, human defensin, ZZHh) | ACYCRIPACIAGERRYGTCIYQGRLW AFCC | 655 |
| AP01158 2RLG, RP-1 (synthetic) | ALYKKFKKKLLKSLKRL | 656 |
| AP00102 8TFV, Thanatin (insect) | GSKKPVPIIYCNRRTGKCQRM | 657 |
| AP00995 A58718, Carnocin UI49 (bacteria) | GSEIQPR | 658 |
| AP01002 AAC18827, Mutacin III (mutacin 1140, bacteria) | KSWSLCTPGCARTGSFNSYCC | 659 |
| AP00987 ABI74601, Arasin 1 (Crustacea) | SRWPSPGRPRPFPGRPKPIFRPRPCNCY APPCPCDRW | 660 |
| AP01000 CAA63706, variacin (lantibiotic, class I bacteriocin, bacteria) | GSGVIPTISHECHMNSFQFVFTCCS | 661 |
| AP00361 O15946, Lebocin 4 (insect, silk moth) | DLRFWNPREKLPLPTLPPFNPKPIYID MGNRY | 662 |
| AP00343 O16825, Andropin (insect, fruit fly) | VFIDILDKMENAIHKAAQAGIGIAKPIE KMILPK | 663 |
| AP00417 O17513, Ceratotoxin D (insect, fly) | SIGTAVKKAVPIAKKVGKVAIPIAKAV LSVVGQLVG | 664 |
| AP00435 O18494, Styelin C (sea squirt, tunicate, XXA) | GWFGKAFRSVSNFYKKHKTYIHAGLS AATLL | 665 |
| AP00330 O18495, Styelin D (Sea squirt, tunicate, XXA) | GWLRKAAKSVGKFYYKHKYYIKAA WQIGKHAL | 666 |
| AP00331 O18495, Styelin E (Sea squirt, tunicate, XXA) | GWLRKAAKSVGKFYYKHKYYIKAA WKIGRHAL | 667 |
| AP01001 O54329, Mutacin II (lantibiotic, mutacin H-29B, J-T8, class I bacteriocin, bacteria) | NRWWQGVVPTVSYECRMNSWQHVF TCC | 668 |
| AP00342 O81338, Antimicrobial peptide 1 (plant) | AKCIKNGKGCREDQGPPFCCSGFCYR QVGWARGYCKNR | 669 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00373 O96059, Moricin 2 (insect) | AKIPIKAIKTVGKAVGKGLRAINIASTA NDVFNFLKPKKRKH | 670 |
| AP00449 P01190, Melanotropin alpha (Alpha-MSH) | SYSMEHFRWGKPV | 671 |
| AP00187 P01376, CORTICOSTATIN III (MCP-1, rabbit neutrophil peptide 1, NP-1) (animal defensin, alpha-defensin, rabbit) | VVCACRRALCLPRERRAGFCRIRGRIH PLCCRR | 672 |
| AP00188 P01377, CORTICOSTATIN IV (MCP-2, rabbit neutrophil defensin 2, NP-2, animal defensin, rabbit) | VVCACRRALCLPLERRAGFCRIRGRIH PLCCRR | 673 |
| AP00049 P01505, Bombinin (toad) | GIGALSAKGALKGLAKGLAEHFAN | 674 |
| AP00139 P01507, Cecropin A (insect, ZZHa) | KWKLFKKIEKVGQNIRDGIIKAGPAVA VVGQATQIAK | 675 |
| AP00128 P01509, Cecropin B (insect, silk moth) | KWKIFKKIEKVGRNIRNGIIKAGPAVA VLGEAKAL | 676 |
| AP00131 P01511, Cecropin D (insect, moth) | WNPFKELERAGQRVRDAIISAGPAVA TVAQATALAK | 677 |
| AP00136 P01518, Crabrolin (insect, XXA) | FLPLILRKIVTAL | 678 |
| AP00183 P04142, Cecropin B (insect) | RWKIFKKIEKMGRNIRDGIVKAGPAIE VLGSAKAI | 679 |
| AP00448 P04205, Mastoparan M (MP-M, insect, XXA) | INLKAIAALAKKLL | 680 |
| AP00234 P06833, Seminalplasmin (SPLN, calcium transporter inhibitor, caltrin, cow) | SDEKASPDKHHRFSLSRYAKLANRLA NPKLLETFLSKWIGDRGNRSV | 681 |
| AP00314 P07466, Rabbit neutrophil peptide 5 (NP-5, animal defensin, alpha-defensin) | VFCTCRGFLCGSGERASGSCTINGVRH TLCCRR | 682 |
| AP00189 P07467, Rabbit neutrophil peptide 4 (NP-4) | VSCTCRRFSCGFGERASGSCTVNGVR HTLCCRR | 683 |
| AP00186 P07468, CORTICOSTATIN II (Rabbit neutrophil peptide 3b (NP-3b, rabbit) | GRCVCRKQLLCSYRERRIGDCKIRGV RFPFCCPR | 684 |
| AP00185 P07469, CORTICOSTATIN I (rabbit) | ICACRRRFCPNSERFSGYCRVNGARY VRCCSRR | 685 |
| AP00217 P07469, Rabbit neutrophil defensin 3a (NP-3a, animal defensin, alpha-defensin) | GICACRRRFCPNSERFSGYCRVNGAR YVRCCSRR | 686 |
| AP00067 P07493, Bombolitin II (insect, bee) | SKITDILAKLGKVLAHV | 687 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00068 P07494, Bombolitin III (insect, bee) | IKIMDILAKLGKVLAHV | 688 |
| AP00069 P07495, Bombolitin IV (insect, bee) | INIKDILAKLVKVLGHV | 689 |
| AP00070 P07496, Bombolitin V (insect, bee) | INVLGILGLLGKALSHL | 690 |
| AP00236 P07504, Pyrularia thionin (Pp-TH, plant) | KSCCRNTWARNCYNVCRLPGTISREIC AKKCDCKIISGTTCPSDYPK | 691 |
| AP00230 P08375, Sarcotoxin IA (insect, flesh) | GWLKKIGKKIERVGQHTRDATIQGLGI AQQAANVAATAR | 692 |
| AP00231 P08376, Sarcotoxin IB (insect, flesh) | GWLKKIGKKIERVGQHTRDATIQVIG VAQQAANVAATAR | 693 |
| AP00232 P08377, Sarcotoxin IC (insect, flesh) | GWLRKIGKKIERVGQHTRDATIQVLGI AQQAANVAATAR | 694 |
| AP00066 P10521, Bombolitin I (insect, bee) | IKITTMLAKLGKVLAHV | 695 |
| AP00206 P10946, Lantibiotic subtilin (class I bacteriocin, bacteria) | WKSESLCTPGCVTGALQTCFLQTLTC NCKISK | 696 |
| AP00312 P11477, Cryptdin-2 (Crp2, animal defensin, alpha, mouse) | LRDLVCYCRARGCKGRERMNGTCRK GHLLYMLCCR | 697 |
| AP00205 P13068, Nisin A (lantibiotic, class I bacteriocin, bacteria) | ITSISLCTPGCKTGALMGCNMKTATC HCSIHVSK | 698 |
| AP00215 P14214, Tachyplesin II (crabs, *Crustacea*) | RWCFRVCYRGICYRKCR | 699 |
| AP00212 P14216, Polyphemusin II (crabs, *Crustacea*, XXA, ZZHa. Derivatives: T22) | RRWCFRVCYKGFCYRKCR | 700 |
| AP00134 P14661, Cecropin P1 (pig) | SWLSKTAKKLENSAKKRISEGIAIAIQ GGPR | 701 |
| AP00011 P14662, Bactericidin B2 (insect) | WNPFKELERAGQRVRDAVISAAPAVA TVGQAAAIARG | 702 |
| AP00032 P14663, Bactericidin B-3 (insect) | WNPFKELERAGQRVRDAIISAGPAVA TVGQAAAIARG | 703 |
| AP00033 P14664, Bactericidin B-4 (insect) | WNPFKELERAGQRVRDAIISAAPAVA TVGQAAAIARG | 704 |
| AP00034 P14665, Bactericidin B-5P (insect) | WNPFKELERAGQRVRDAVISAAAVAT VGQAAAIARG | 705 |
| AP00125 P14666, Cecropin (insect, silk moth) | RWKIFKKIEKVGQNIRDGIVKAGPAV AVVGQAATI | 706 |
| AP00002 P15450, ABAECIN (insect, honeybee) | YVPLPNVPQPGRRPFPTFPGQGPFNPKI KWPQGY | 707 |
| AP00505 P15516, human Histatin 5 (ZZHs; derivatives Dh-5) | DSHAKRHHGYKRKFHEKHHSHRGY | 708 |
| AP00520 P15516, human Histatin 3 | DSHAKRHHGYKRKFHEKHHSHRGYR SNYLYDN | 709 |
| AP00523 P15516, human Histatin 8 | KFHEKHHSHRGY | 710 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00226 P17722, Royalisin (insect, honeybee) | VTCDLLSFKGQVNDSACAANCLSLGK AGGHCEKVGCICRKTSFKDLWDKRF | 711 |
| AP00213 P18252, Tachyplesin III (horseshoe crabs, *Crustacea*) | KWCFRVCYRGICYRKCR | 712 |
| AP00233 P18312, Sarcotoxin ID (insect, flesh) | GWIRDFGKRIERVGQHTRDATIQTIAV AQQAANVAATLKG | 713 |
| AP00207 P19578, Lantibiotic PEP5 (class I bacteriocin, bacteria) | TAGPAIRASVKQCQKTLKATRLFTVS CKGKNGCK | 714 |
| AP00009 P19660, BACTENECIN 5 (bac5, cow cathelicidin) | RFRPPIRRPPIRPPFYPPFRPPIRPPIFPPI RPPFRPPLGPFP | 715 |
| AP00010 P19661, BACTENECIN 7 (bac7, cow cathelicidin) | RRIRPRPPRLPRPRPRPLPFPRPGPRPIP RPLPFPRPGPRPIPRPLPFPRPGPRPIPRPL | 716 |
| AP00200 P21564, Mastoparan B (MP-B, insect, XXA) | LKLKSIVSWAKKVL | 717 |
| AP00005 P21663, Andropin (insect, fly) | VFIDILDKVENAIHNAAQVGIGFAKPF EKLINPK | 718 |
| AP00008 P22226, Cyclic dodecapeptide (cow cathelicidin) | RLCRIVVIRVCR | 719 |
| AP01205 P23826, Lactocin S (XXD3, bacteria) | STPVLASVAVSMELLPTASVLYSDVA GCFKYSAKHHC | 720 |
| AP00239 P24335, XPF (the xenopsin precursor fragment, African clawed frog) | GWASKIGQTLGKIAKVGLKELIQPK | 721 |
| AP00235 P25068, Bovine tracheal antimicrobial peptide (TAP, cow) | NPVSCVRNKGICVPIRCPGSMKQIGTC VGRAVKCCRKK | 722 |
| AP00418 P25230, CAP18 (rabbit cathelicidin, BBL) | GLRKRLRKFRNKIKEKLKKIGQKIQGF VPKLAPRTDY | 723 |
| AP00203 P25403, Mj-AMP1 (MjAMP1, plant defensin) | QCIGNGGRCNENVGPPYCCSGFCLRQ PGQGYGYCKNR | 724 |
| AP00202 P25404, Mj-AMP2 (MjAMP2, plant defensin) | CIGNGGRCNENVGPPYCCSGFCLRQP NQGYGVCRNR | 725 |
| AP00138 P28310, Cryptdin-3 (Crp3, animal defensin, alpha, mouse) | LRDLVCYCRKRGCKRRERMNGTCRK GHLMYTLCCR | 726 |
| AP00184 P28794, MBP-1 (plant) | RSGRGECRRQCLRRHEGQPWETQEC MRRCRRRG | 727 |
| AP00050 P29002, Bombinin-like peptide 1 (BLP-1, toad) | GIGASILSAGKSALKGLAKGLAEHFAN | 728 |
| AP00051 P29003, Bombinin-like peptide 2 (BLP-2, toad) | GIGSAILSAGKSALKGLAKGLAEHFAN | 729 |
| AP00052 P29004, Bombinin-like peptide 3 (BLP-3, XXA, toad) | GIGAAILSAGKSALKGLAKGLAEHF | 730 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00053 P29005, Bombinin-like peptide 4 (BLP-4, toad) | GIGAAILSAGKSIIKGLANGLAEHF | 731 |
| AP00634 P29430, Pediocin PA-1/AcH (PedPA1, class IIA bacteriocin, bacteria) | KYYGNGVTCGKHSCSVDWGKATTCII NNGAMAWATGGHQGNHKC | 732 |
| AP00204 P29559, Nisin Z (lantibiotic, class I bacteriocin, bacteria) | ITSISLCTPGCKTGALMGCNMKTATC NCSIHVSK | 733 |
| AP00130 P29561, Cecropin C (insect, fly) | GWLKKLGKRIERIGQHTRDATIQGLGI AQQAANVAATAR | 734 |
| AP00001 P31107, ADENOREGULIN (Dermaseptin B2, Dermaseptin-B2, DRS-B2, DRS B2, frog) | GLWSKIKEVGKEAAKAAAKAAGKAA LGAVSEAV | 735 |
| AP00228 P31529, Sapecin B (insect, flesh fly) | LTCEIDRSLCLLHCRLKGYLRAYCSQQ KVCRCVQ | 736 |
| AP00229 P31530, Sapecin C (insect, flesh fly) | ATCDLLSGIGVQHSACALHCVFRGNR GGYCTGKGICVCRN | 737 |
| AP00218 P32195, Protegrin 2 (PG-2, pig cathelicidin) | RGGRLCYCRRRFCICV | 738 |
| AP00219 P32196, Protegrin 3 (PG-3, pig cathelicidin) | RGGGLCYCRRRFCVCVGR | 739 |
| AP00073 P32412, Brevinin-1E (frog) | FLPLLAGLAANFLPKIFCKITRKC | 740 |
| AP00080 P32414, Esculentin-1 (frog) | GIFSKLGRKKIKNLLISGLKNVGKEVG MDVVRTGIDIAGCKIKGEC | 741 |
| AP00074 P32423, Brevinin-1 (frog) | FLPVLAGIAAKVVPALFCKITKKC | 742 |
| AP00075 P32424, Brevinin-2 (frog) | GLLDSLKGFAATAGKGVLQSLLSTAS CKLAKTC | 743 |
| AP00175 P34084, Macaque histatin (M-Histatin 1, primate, monkey) | DSHEERHHGRHGHHKYGRKFHEKHH SHRGYRSNYLYDN | 744 |
| AP00006 P35581, Apidaecin IA (insect, honeybee) | GNNRPVYIPQPRPPHPRI | 745 |
| AP00007 P35581, Apidaecin IB (insect, honeybee) | GNNRPVYIPQPRPPHPRL | 746 |
| AP00414 P36190, Ceratotoxin A (insect, fly) | SIGSALKKALPVAKKIGKIALPIAKAA LP | 747 |
| AP00415 P36191, Ceratotoxin B (insect, fly) | SIGSAFKKALPVAKKIGKAALPIAKAA LP | 748 |
| AP00172 P36193, Drosocin (insect) | GKPRPYSPRPTSHPRPIRV | 749 |
| AP00170 P37362, Pyrrhocoricin (insect) | VDKGSYLPRPTPPRPIYNRN | 750 |
| AP00635 P38577, Mesentericin Y105 (MesY105, class IIA bacteriocin, bacteria) | KYYGNGVHCTKSGCSVNWGEAASAG IHRLANGGNGFW | 751 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00636 P38579, Carnobacteriocin BM1 (CnbBM1, PiscV1b, class IIA bacteriocin, bacteria) | AISYGNGVYCNKEKCWVNKAENKQA ITGIVIGGWASSLAGMGH | 752 |
| AP00209 P39080, Peptide PGQ (frog) | GVLSNVIGYLKKLGTGALNAVLKQ | 753 |
| AP00513 P39084, Ranalexin (frog) | FLGGLIKIVPAMICAVTKKC | 754 |
| AP00071 P40835, Brevinin-1EA (frog) | FLPAIFRMAAKVVPTIICSITKKC | 755 |
| AP00072 P40836, Brevinin-1EB (frog) | VIPFVASVAAEMQHVYCAASRKC | 756 |
| AP00076 P40837, Brevinin-2EA (frog) | GILDTLKNLAISAAKGAAQGLVNKAS CKLSGQC | 757 |
| AP00077 P40838, Brevinin-2EB (frog) | GILDTLKNLAKTAGKGALQGLVKMA SCKLSGQC | 758 |
| AP00078 P40839, Brevinin-2EC (frog) | GILLDKLKNFAKTAGKGVLQSLLNTA SCKLSGQC | 759 |
| AP00079 P40840, Brevinin-2ED (frog) | GILDSLKNAKNAGQILLNKASCKLSG QC | 760 |
| AP00081 P40843, Esculentin-1A (frog) | GIFSKLAGKKIKNLLISGLKNVGKEVG MDVVRTGIDIAGCKIKGEC | 761 |
| AP00082 P40844, Esculentin-1B (frog) | GIFSKLAGKKLKNLLISGLKNVGKEVG MDVVRTGIDIAGCKIKGEC | 762 |
| AP00083 P40845, Esculentin-2A (frog) | GILSLVKGVAKLAGKGLAKEGGKFGL ELIACKIAKQC | 763 |
| AP00084 P40846, Esculentin-2B (ES2B_RANES, frog) | GIFSLVKGAAKLAGKGLAKEGGKFGL ELIACKIAKQC | 764 |
| AP00299 P46156, Chicken gallinacin 1 (Gal 1, avian beta-defensin, bird) | GRKSDCFRKSGFCAFLKCPSLTLISGK CSRFYLCCKRIW | 765 |
| AP00300 P46157, Gallinacin 1 alpha (avian beta-defensin, Bird), | GRKSDCFRKNGFCAFLKCPYLTLISGK CSRFHLCCKRIW | 766 |
| AP00298 P46158, Chicken gallinacin 2 (Gal 2, avian beta-defensin, bird) | LFCKGGSCHFGGCPSHLIKVGSCFGFR SCCKWPWNA | 767 |
| AP00037 P46160, Beta-defensin 2 (cow) | VRNHVTCRINRGFCVPIRCPGRTRQIG TCFGPRIKCCRSW | 768 |
| AP00038 P46161, Beta-defensin 3 (cow) | QGVRNHVTCRINRGFCVPIRCPGRTRQ IGTCFGPRIKCCRSW | 769 |
| AP00039 P46162, Beta-defensin 4 (cow) | QRVRNPQSCRWNMGVCIPFLCRVGM RQIGTCFGPRVPCCRR | 770 |
| AP00040 P46163, Beta-defensin 5 (cow) | QVVRNPQSCRWNMGVCIPISCPGNMR QIGTCFGPRVPCCRRW | 771 |
| AP00041 P46164, Beta-defensin 6 (cow) | QGVRNHVTCRIYGGFCVPIRCPGRTR QIGTCFGRPVKCCRRW | 772 |
| AP00042 P46165, Beta-defensin 7 (cow) | QGVRNFVTCRINRGFCVPIRCPGHRRQ IGTCLGPRIKCCR | 773 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00043 P46166, Beta-defensin 8 (cow) | VRNFVTCRINRGFCVPIRCPGHRRQIG TCLGPQIKCCR | 774 |
| AP00044 P46167, Beta-defensin 9 (cow) | QGVRNFVTCRINRGFCVPIRCPGHRRQ IGTCLAPQIKCCR | 775 |
| AP00045 P46168, Beta-defensin 10 (cow) | QGVRSYLSCWGNRGICLLNRCPGRMR QIGTCLAPRVKCCR | 776 |
| AP00046 P46169, Beta-defensin 11 (cow) | GPLSCRRNGGVCIPIRCPGPMRQIGTC FGRPVKCCRSW | 777 |
| AP00048 P46171, Bovine beta-defensin 13 (cow) | SGISGPLSCGRNGGVCIPIRCPVPMRQI GTCFGRPVKCCRSW | 778 |
| AP00350 P48821, Enbocin (insect, moth) | PWNIFKEIERAVARTRDAVISAGPAVR TVAAATSVAS | 779 |
| AP00173 P49112, GNCP-2 (Guinea pig neutrophil cationic peptide 2) | RCICTTRTCRFPYRRLGTCLFQNRVYT FCC | 780 |
| AP00369 P49930, PMAP-23 (PMAP23, pig cathelicidin) | RIIDLLWRVRRPQKPKFVTVWVR | 781 |
| AP00370 P49931, PMAP-36 (PMAP36, pig cathelicidin) | VGRFRRLRKKTRKRLKKIGKVLKWIP PIVGSIPLGCG | 782 |
| AP00371 P49932, PMAP-37 (PMAP37, pig cathelicidin) | GLLSRLRDFLSDRGRRLGEKIERIGQKI KDLSEFFQS | 783 |
| AP00220 P49933, Protegrin 4 (PG-4, pig cathelicidin) | RGGRLCYCRGWICFCVGR | 784 |
| AP00221 P49934, Protegrin 5 (PG-5, pig cathelicidin) | RGGRLCYCRPRFCVCVGR | 785 |
| AP00346 P50720, Hyphancin IIID (Fall webworm, insect) | RWKIFKKIERVGQNVRDGIIKAGPAIQ VLGTAKAL | 786 |
| AP00347 P50721, Hyphancin IIIE (Fall webworm, insect) | RWKFFKKIERVGQNVRDGLIKAGPAI QVLGAAKAL | 787 |
| AP00348 P50722, Hyphancin IIIF (Fall webworm, insect) | RWKVFKKIEKVGRNIRDGVIKAGPAI AVVGQAKAL | 788 |
| AP00349 P50723, Hyphancin IIIG (Fall webworm, insect) | RWKVFKKIEKVGRHIRDGVIKAGPAIT VVGQATAL | 789 |
| AP00281 P51473, mCRAMP (mouse cathelicidin; derivatives: CRAMP 18) | GLLRKGGEKIGEKLKKIGQKIKNFFQK LVPQPEQ | 790 |
| AP00366 P54228, BMAP-27 (BMAP27, cow cathelicidin, ZZHs, derivatives BMAP-18 and BMAP-15) | GRFKRFRKKFKKLFKKLSPVIPLLHLG | 791 |
| AP00367 P54229, BMAP-28 (BMAP28, cow cathelicidin) | GGLRSLGRKILRAWKKYGPIIVPIIRIG | 792 |
| AP00450 P54230, Cyclic dodecapeptide (sheep cathelicidin) | RICRIIFLRVCR | 793 |
| AP00359 P54684, Lebocin 1/2 (insect, silk moth) | DLRFLYPRGKLPVPTPPPFNPKPIYIDM GNRY | 794 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00360 P55796, Lebocin 3 (insect, silk moth) | DLRFLYPRGKLPVPTLPPFNPKPIYIDMGNRY | 795 |
| AP00307 P55897, Buforin I (toad) | AGRGKQGGKVRAKAKTRSSRAGLQFPVGRVHRLLRKGNY | 796 |
| AP00308 P55897, Buforin II (toad) | TRSSRAGLQFPVGRVHRLLRK | 797 |
| AP00240 P56226, Caerin 1.1 (frog, ZZHa) | GLLSVLGSVAKHVLPHVVPVIAEHL | 798 |
| AP00241 P56227, Caerin 1.2 (frog) | GLLGVLGSVAKHVLPHVVPVIAEHL | 799 |
| AP00242 P56228, Caerin 1.3 (frog) | GLLSVLGSVAQHVLPHVVPVIAEHL | 800 |
| AP00243 P56229, Caerin 1.4 (frog) | GLLSSLSSVAKHVLPHVVPVIAEHL | 801 |
| AP00244 P56230, Caerin 1.5 (frog) | GLLSVLGSVVKHVIPHVVPVIAEHL | 802 |
| AP00245 P56231, Caerin 1.6 (frog) | GLFSVLGAVAKHVLPHVVPVIAEK | 803 |
| AP00246 P56232, Caerin 1.7 (frog) | GLFKVLGSVAKHLLPHVAPVIAEK | 804 |
| AP00249 P56233, Caerin 2.1 (frog) | GLVSSIGRALGGLLADVVKSKGQPA | 805 |
| AP00250 P56234, Caerin 2.2 (frog) | GLVSSIGRALGGLLADVVKSKEQPA | 806 |
| AP00251 P56236, Caerin 2.4 (frog) | GLVSSIGKALGGLLADVVKTKEQPA | 807 |
| AP00252 P56236, Caerin 2.5 (frog) | GLVSSIGRALGGLLADVVKSKEQPA | 808 |
| AP00253 P56238, Caerin 3.1 (frog) | GLWQKIKDKASELVSGIVEGVK | 809 |
| AP00254 P56238, Caerin 3.2 (frog) | GLWEKIKEKASELVSGIVEGVK | 810 |
| AP00255 P56240, Caerin 3.3 (frog) | GLWEKIKEKANELVSGIVEGVK | 811 |
| AP00256 P56241, Caerin 3.4 (frog) | GLWEKIREKANELVSGIVEGVK | 812 |
| AP00257 P56242, Caerin 4.1 (frog) | GLWQKIKSAAGDLASGIVEGIKS | 813 |
| AP00258 P56243, Caerin 4.2 (frog) | GLWQKIKSAAGDLASGIVEAIKS | 814 |
| AP00259 P56244, Caerin 4.3 (frog) | GLWQKIKNAAGDLASGIVEGIKS | 815 |
| AP00434 P56249, Frenatin 3 (frog) | GLMSVLGHAVGNVLGGLFKS | 816 |
| AP00272 P56386, Murine beta-defensin 1 (mBD-1, mouse) | DQYKCLQHGGFCLRSSCPSNTKLQGTCKPDKPNCCKS | 817 |
| AP00368 P56425, BMAP-34 (BMAP34, cow cathelicidin) | GLFRRLRDSIRRGQQKILEKARRIGERIKDIFRG | 818 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00273 P56685, Buthinin (Sahara scorpion) | SIVPIRCRSNRDCRRFCGFRGGRCTYA RQCLCGY | 819 |
| AP00282 P56872, Cyclopsychotride A (CPT, plant cyclotides, XXC) | SIPCGESCVFIPCTVTALLGCSCKSVC YKN | 820 |
| AP00094 P56917, Temporin A (XXA, frog) | FLPLIGRVLSGIL | 821 |
| AP00096 P56918, Temporin C (XXA, frog) | LLPILGNLLNGLL | 822 |
| AP00097 P56920, Temporin E (XXA, frog) | VLPIIGNLLNSLL | 823 |
| AP00098 P56921, Temporin F (XXA, frog) | FLPLIGKVLSGIL | 824 |
| AP00100 P56923, Temporin K (XXA, frog) | LLPNLLKSLL | 825 |
| AP00295 P56928, eNAP-2 (horse) | EVERKHPLGGSRPGRCPTVPPGTFGHC ACLCTGDASEPKGQKCCSN | 826 |
| AP00101 P57104, Temporin L (XXA, frog) | FVQWFSKFLGRIL | 827 |
| AP00095 P79874, Temporin B (XXA, frog) | LLPIVGNLLKSLL | 828 |
| AP00099 P79875, Temporin G (XXA, frog) | FFPVIGRILNGIL | 829 |
| AP00413 P80032, Coleoptericin (insect) | SLQGGAPNFPQPSQQNGGWQVSPDLG RDDKGNTRGQIEIQNKGKDHDFNAG WGKVIRGPNKAKPTWHVGGTYRR | 830 |
| AP00396 P80054, PR-39 (PR39, pig cathelicidin) | RRRPRPPYLPRPRPPPFFPPRLPPRIPPG FPPRFPPRFP | 831 |
| AP00182 P80154, Insect defensin | GFGCPLDQMQCHRHCQTITGRSGGYC SGPLKLTCTCYR | 832 |
| AP00444 P80223, Corticostatin VI (CS-VI) (animal defensin, rabbit) | GICACRRRFCLNFEQFSGYCRVNGAR YVRCCSRR | 833 |
| AP00208 P80230, Peptide 3910 (pig) | RADTQTYQPYNKDWIKEKIYVLLRRQ AQQAGK | 834 |
| AP00157 P80277, Dermaseptin-S1 (Dermaseptin S1, DRS S1, DRS-S1, frog) | ALWKTMLKKLGTMALHAGKAALGA AADTISQGTQ | 835 |
| AP00158 P80278, Dermaseptin-S2 (Dermaseptin S2, DRS S2, DRS-S2, frog) | ALWFTMLKKLGTMALHAGKAALGA AANTISQGTQ | 836 |
| AP00159 P80279, Dermaseptin-S3 (Dermaseptin S3, DRS S3, DRS-S3, frog) | ALWKNMLKGIGKLAGKAALGAVKKL VGAES | 837 |
| AP00160 P80280, Dermaseptin-S4 (Dermaseptin S4, DRS S4, DRS-S4, frog) | ALWMTLLKKVLKAAAKALNAVLVG ANA | 838 |
| AP00161 P80281, Dermaseptin-S5 (Dermaseptin S5, DRS S5, DRS-S5, frog) | GLWSKIKTAGKSVAKAAAKAAVKAV TNAV | 839 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00293 P80282, Dermaseptin-B1 (DRS-B1, DRS B1, frog) | AMWKDVLKKIGTVALHAGKAALGA VADTISQ | 840 |
| AP00264 P80389, Chicken Heterophil Peptide 1 (CHP1, bird, animal) | GRKSDCFRKSGFCAFLKCPSLTLISGK CSRFYLCCKRIR | 841 |
| AP00265 P80390, Chicken Heterophil Peptide 2 (CHP2, bird, animal) | GRKSDCFRKNGFCAFLKCPYLTLISGL CSFHLC | 842 |
| AP00266 P80391, Turkey Heterophil Peptide 1 (THP1, turkey) | GKREKCLRRNGFCAFLKCPTLSVISGT CSRFQVCC | 843 |
| AP00267 P80392, Turkey Heterophil Peptide 2 (THP2, bird, anaimal) | LFCKRGTCHFGRCPSHLIKVGSCFGFR SCCKWPWDA | 844 |
| AP00269 P80393, Turkey Heterophil Peptide 3 (THP3, bird, animal) | LSCKRGTCHFGRCPSHLIKGSCSGG | 845 |
| AP00085 P80395, Gaegurin-1 (Gaegurin 1, frog) | SLFSLIKAGAKFLGKNLLKQGACYAA CKASKQC | 846 |
| AP00086 P80396, Gaegurin-2 (Gaegurin 2, frog) | GIMSIVKDVAKNAAKEAAKGALSTLS CKLAKTC | 847 |
| AP00087 P80397, Gaegurin-3 (Gaegurin 3, frog) | GIMSIVKDVAKTAAKEAAKGALSTLS CKLAKTC | 848 |
| AP00089 P80399, Gaegurin-5 (Gaegurin 5, frog) | FLGALFKVASKVLPSVFCAITKKC | 849 |
| AP00090 P80400, Gaegurin-6 (Gaegurin 6, frog) | FLPLLAGLAANFLPTIICKISYKC | 850 |
| AP00362 P80408, Metalnikowin I (insect) | VDKPDYRPRPRPPNM | 851 |
| AP00363 P80409, Metalnikowin IIA (insect) | VDKPDYRPRPWPRPN | 852 |
| AP00364 P80410, Metalnikowin IIB (insect) | VDKPDYRPRPWPRNMI | 853 |
| AP00365 P80411, Metalnikowin III (insect) | VDKPDYRPRPWPRPNM | 854 |
| AP00632 P80569, Piscicolin 126/ Piscicocin Via (PiscV1a, Pisc126, class IIA bacteriocin, bacteria) | KYYGNGVSCNKNGCTVDWSKAIGIIG NNAAANLTTGGAAGWNKG | 855 |
| AP01003 P80666, Mutacin B-Ny266 (bacteria) | FKSWSFCTPGCAKTGSFNSYCC | 856 |
| AP00276 P80710, Clavanin A (urochordates, sea squirts, and sea pork, tunicate) | VFQFLGKIIHHVGNFVHGFSHVF | 857 |
| AP00277 P80711, Clavanin B (Sea squirt, tunicate) | VFQFLGRIIHHVGNFVHGFSHVF | 858 |
| AP00278 P80712, Clavanin C (Sea squirt, tunicate) | VFHLLGKIIHHVGNFVYGFSHVF | 859 |
| AP00279 P80713, Clavanin D (Sea squirt, tunicate) | AFKLLGRIIHHVGNFVYGFSHVF | 860 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00280 P80713, Clavanin D (Sea squirt, tunicate) | LFKLLGKIIHHVGNFVHGFSHVF | 861 |
| AP00294 P80930, eNAP-1 (horse) | DVQCGEGHFCHDQTCCRASQGGACC PYSQGVCCADQRHCCPVGF | 862 |
| AP00400 P80952, Skin peptide tyrosine-tyrosine (skin-PYY, SPYY, frog) | YPPKPESPGEDASPEEMNKYLTALRH YINLVTRQRY | 863 |
| AP00091 P80954, Rugosin A (frog) | GLLNTFKDWAISIAKGAGKGVLTTLS CKLDKSC | 864 |
| AP00092 P80955, Rugosin B (frog) | SLFSLIKAGAKFLGKNLLKQGAQYAA CKVSKEC | 865 |
| AP00093 P80956, Rugosin C (frog) | GILDSFKQFAKGVGKDLIKGAAQGVL STMSCKLAKTC | 866 |
| AP00392 P81056, Penaeidin-1 (shrimp, Crustacea) | YRGGYTGPIPRPPPIGRPPLRLVVCAC YRLSVSDARNCCIKFGSCCHLVK | 867 |
| AP00393 P81057, Penaeidin-2a (shrimp, Crustacea) | YRGGYTGPIPRPPPIGRPPFRPVCNACY RLSVSDARNCCIKFGSCCHLVK | 868 |
| AP00394 P81058, Penaeidin-3a (shrimp, Crustacea) | QVYKGGYTRPIPRPPPFVRPLPGGPIGP YNGCPVSCRGISFSQARSCCSRLGRCC HVGKGYS | 869 |
| AP00247 P81251, Caerin 1.8 (frog) | GLFKVLGSVAKHLLPHVVPVIAEK | 870 |
| AP00248 P81252, Caerin 1.9 (frog, ZZHa) | GLFGVLGSIAKHVLPHVVPVIAEK | 871 |
| AP00126 P81417, Cecropin A (insect, mosquito) | GGLKKLGKKLEGVGKRVFKASEKAL PVAVGIKALG | 872 |
| AP00169 P81437, Formaecin 2 (insect, ants) | GRPNPVNTKPTPYPRL | 873 |
| AP00168 P81438, Formaecin 1 (insect, ants) | GRPNPVNNKPTPHPRL | 874 |
| AP00296 P81456, Fabatin-1 (plant defensin) | LLGRCKVKSNRFHGPCLTDTHCSTVC RGEGYKGGDCHGLRRRCMCLC | 875 |
| AP00297 P81457, Fabatin-2 (plant defensin) | LLGRCKVKSNRFNGPCLTDTHCSTVC RGEGYKGGDCHGLRRRCMCLC | 876 |
| AP01215 P81463, European bumblebee abaecin (insect) | FVPYNPPRPYQSKPFPSFPGHGPFNPKI QWPYPLPNPGH | 877 |
| AP01214 P81464, Apidaecin (insect) | GNRPVYIPPPRPPHPRL | 878 |
| AP00440 P81465, defensin HANP-1 (hamster) | VTCFCRRRGCASRERHIGYCRFGNTIY RLCCRR | 879 |
| AP00441 P81466, defensin HANP-2 (hamster) | CFCKRPVCDSGETQIGYCRLGNTFYRL CCRQ | 880 |
| AP00442 P81467, defensin HANP-3 (hamster) | VTCFCRRRGCASRERLIGYCRFGNTIY GLCCRR | 881 |
| AP00439 P81468, defensin HANP-4 (hamster) | VTCFCKRPVCDSGETQIGYCRLGNTF YRLCCRQ | 882 |
| AP00328 P81469, Styelin A (Sea squirt, tunicate, XXA) | GFGKAFHSVSNFAKKHKTA | 883 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00329 P81470, Styelin B (Sea squirt, tunicate, XXA) | GFGPAFHSVSNFAKKHKTA | 884 |
| AP00492 P81474, Misgurin (fish) | RQRVEELSKFSKKGAAARRRK | 885 |
| AP00165 P81485, Dermaseptin-B3 (Dermaseptin B3, DRS-B3, DRS B3, frog) | ALWKNMLKGIGKLAGQAALGAVKTLVGAE | 886 |
| AP00163 P81486, Dermaseptin-B4 (Dermaseptin B4, DRS-B4, DRS B4, DRS-TR1, IRP, frog) | ALWKDILKNVGKAAGKAVLNTVTDMVNQ | 887 |
| AP00162 P81487, Dermaseptin-B5 (Dermaseptin B5, DRS-B5, DRS B5, frog) | GLWNKIKEAASKAAGKAALGFVNEMV | 888 |
| AP00164 P81488, Dermaseptin-B9 (Dermaseptin B9, DRS-B9, DRS DRG3, frog) | ALWKTIIKGAGKMIGSLAKNLLGSQAQPES | 889 |
| AP00167 P81565, Phylloxin (phylloxin-B1, PLX-B1, XXA, frog) | GWMSKIASGIGTFLSGMQQ | 890 |
| AP00291 P81568, Defensin D5 (So-D5) (plant defensin) | MFFSSKKCKTVSKTFRGPCVRNAN | 891 |
| AP00290 P81569, Defensin D4 (So-D4) (plant defensin) | MFFSSKKCKTVSKTFRGPCVRNA | 892 |
| AP00289 P81570, Defensin D3 (So-D3) (plant defensin) | GIFSSRKCKTVSKTFRGICTRNANC | 893 |
| AP00288 P81572, Defensin D1 (So-D1) (plant defensin) | TCESPSHKFKGPCATNRNCES | 894 |
| AP00292 P81573, Defensin D7 (So-D7) (plant defensin) | GIFSSRKCKTPSKTFKGYCTRDSNCDTSCRYEGYPAGD | 895 |
| AP00270 P81591, Pn-AMP (PnAMP, plant defensin) | QQCGRQASGRLCGNRLCCSQWGYCGSTASYCGAGCQSQCRS | 896 |
| AP00412 P81592, Acaloleptin A1 (insect) | SLQPGAPNVNNKDQPWQVSPHISRDDSGNTRTDINVQRHGENNDFEAGWSKVVRGPNKAKPTWHIGGTHRW | 897 |
| AP00433 P81605, human Dermcidin (DCD-1) | SSLLEKGLDGAKKAVGGLGKLGKDAVEDLESVGKGAVHDVKDVLDSV | 898 |
| AP00332 P81612, Mytilin A (Blue mussel) | GCASRCKAKCAGRRCKGWASASFRGRCYCKCFRC | 899 |
| AP00333 P81613, Mytilin B (Blue mussel) | SCASRCKGHCRARRCGYYVSVLYRGRCYCKCLRC | 900 |
| AP00334 P81613, Moronecidin (fish) | FFHHIFRGIVHVGKTIHKLVTG | 901 |
| AP00351 P81835, Citropin 1.1 (amphibian, frog) | GLFDVIKKVASVIGGL | 902 |
| AP00352 P81840, Citropin 1.2 (amphibian, frog) | GLFDIIKKVASVVGGL | 903 |
| AP00353 P81846, Citropin 1.3 (amphibian, frog) | GLFDIIKKVASVIGGL | 904 |
| AP00338 P81903, Histone H2B-1(HLP-1) (fish) | PDPAKTAPKKGSKKAVTKA | 905 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00271 P82018, ChBac5 (Goat cathelicidin) | RFRPPIRRPPIRPPFNPPFRPPVRPPFRPP FRPPFRPPIGPFP | 906 |
| AP00316 P82027, Uperin 2.1 (amphibian, toad) | GIVDFAKKVVGGIRNALGI | 907 |
| AP00317 P82028, Uperin 2.2 (amphibian, toad) | GFVDLAKKVVGGIRNALGI | 908 |
| AP00318 P82029, Uperin 2.3 (amphibian, toad) | GFFDLAKKVVGGIRNALGI | 909 |
| AP00319 P82030, Uperin 2.4 (amphibian, toad) | GILDFAKTVVGGIRNALGI | 910 |
| AP00320 P82031, Uperin 2.5 (amphibian, toad) | GIVDFAKGVLGKIKNVLGI | 911 |
| AP00323 P82032, Uperin 3.1 (amphibian, toad) | GVLDAFRKIATVVKNVV | 912 |
| AP00326 P82035, Uperin 4.1 (amphibian, toad) | GVGSFIHKVVSAIKNVA | 913 |
| AP00321 P82039, Uperin 2.7 (amphibian, toad) | GIIDIAKKLVGGIRNVLGI | 914 |
| AP00322 P82040, Uperin 2.8 (amphibian, toad) | GILDVAKTLVGKLRNVLGI | 915 |
| AP00324 P82042, Uperin 3.5 (amphibian, toad) | GVGDLIRKAVSVIKNIV | 916 |
| AP00325 P82042, Uperin 3.6 (amphibian, toad) | GVIDAAKKVVNVLKNLP | 917 |
| AP00327 P82050, Uperin 7.1 (amphibian, frog) | GWFDVVKHIASAV | 918 |
| AP00260 P82066, Maculatin 1.1 (XXA, frog, ZZHa) | GLFGVLAKVAAHVVPAIAEHF | 919 |
| AP00261 P82067, Maculatin 1.2 (XXA, frog) | GLFVGLAKVAAHNNPAIAEHFQA | 920 |
| AP00262 P82068, Maculatin 2.1 (frog) | GFVDFLKKVAGTIANVVT | 921 |
| AP00263 P82069, Maculatin 3.1 (frog) | GLLQTIKEKLESLESLAKGIVSGIQA | 922 |
| AP00345 P82104, Caerin 1.10 (frog) | GLLSVLGSVAKHVLPHVVPVIAEKL | 923 |
| AP00456 P82232, Brevinin-1T (frog) | VNPIILGVLPKFVCLITKKC | 924 |
| AP00459 P82233, Brevinin-1TA (frog) | FITLLLRKFICSITKKC | 925 |
| AP00457 P82234, Brevinin-2TC (frog) | GLWETIKNFGKKFTLNILHKLKCKIGG GC | 926 |
| AP00458 P82235, Brevinin-2TD (frog) | GLWETIKNFGKKFTLNILHNLKCKIGG GC | 927 |
| AP00397 P82238, Salmocidin 2A (fish, trout) | SGFVLKGYTKTSQ | 928 |
| AP00398 P82239, Salmocidin 2B (fish, trout) | AGFVLKGYTKTSQ | 929 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00055 P82282, Bombinin H1 (frog) | IIGPVLGMVGSALGGLLKKI | 930 |
| AP00056 P82284, Bombinin H4 (frog, XXA, XXD) | LIGPVLGLVGSALGGLLKKI | 931 |
| AP00057 P82285, Bombinin H5 (frog, XXD) | IIGPVLGLVGSALGGLLKKI | 932 |
| AP00419 P82286, Bombinin-like peptides 2 (amphibian, toad) | GIGASILSAGKSALKGFAKGLAEHFAN | 933 |
| AP00137 P82293, Cryptdin-1 (Crp1, animal defensin, alpha, mouse) | LRDLVCYCRTRGCKRRERMNGTCRK GHLMYTLCCR | 934 |
| AP00443 P82317, defensin RMAD-2 (monkey) | ACYCRIPACLAGERRYGTCFYMGRV WAFCC | 935 |
| AP00012 P82386, Aurein 1.1 (amphibian, frog) | GLFDIIKKIAESI | 936 |
| AP00014 P82388, Aurein 2.1 (amphibian, frog) | GLLDIVKKVVGAFGSL | 937 |
| AP00015 P82389, Aurein 2.2 (amphibian, frog) | GLFDIVKKVVGALGSL | 938 |
| AP00016 P82390, Aurein 2.3 (XXA, amphibian, frog) | GLFDIVKKVVGAIGSL | 939 |
| AP00017 P82391, Aurein 2.4 (XXA, amphibian, frog) | GLFDIVKKVVGTIAGL | 940 |
| AP00018 P82392, Aurein 2.5 (XXA, amphibian, frog) | GLFDIVKKVVGAFGSL | 941 |
| AP00019 P82393, Aurein 2.6 (XXA, amphibian, frog) | GLFDIAKKVIGVIGSL | 942 |
| AP00020 P82394, Aurein 3.1 (XXA, amphibian, frog) | GLFDIVKKIAGHIAGSI | 943 |
| AP00021 P82395, Aurein 3.2 (XXA, amphibian, frog) | GLFDIVKKIAGHIASSI | 944 |
| AP00022 P82396, Aurein 3.3 (XXA, amphibian, frog) | GLFDIVKKIAGHIVSSI | 945 |
| AP00376 P82414, Ponericin G1 (ants) | GWKDWAKKAGGWLKKKGPGMAKA ALKAAMQ | 946 |
| AP00377 P82415, Ponericin G2 (ants) | GWKDWLKKGKEWLKAKGPGIVKAA LQAATQ | 947 |
| AP00378 P82416, Ponericin G3 (ants) | GWKDWLNKGKEWLKKKGPGIMKAA LKAATQ | 948 |
| AP00379 P82417, Ponericin G4 (ants) | DFKDWMKTAGEWLKKKGPGILKAA MAAAT | 949 |
| AP00380 P82418, Ponericin G5 (ants) | GLKDWVKIAGGWLKKKGPGILKAAM AAATQ | 950 |
| AP00381 P82419, Ponericin G6 (ants) | GLVDVLGKVGGLIKKLLP | 951 |
| AP00382 P82420, Ponericin G7 (ants) | GLVDVLGKVGGLIKKLLPG | 952 |
| AP00383 P82421, Ponericin L1 (ants) | LLKELWTKMKGAGKAVLGKIKGLL | 953 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00384 P82422, Ponericin L2 (ants) | LLKELWTKIKGAGKAVLGKIKGLL | 954 |
| AP00386 P82423, Ponericin W1 (ants) | WLGSALKIGAKLLPSVVGLFKKKQ | 955 |
| AP00387 P82424, Ponericin W2 (ants) | WLGSALKIGAKLLPSVVGLFQKKKK | 956 |
| AP00388 P82425, Ponericin W3 (ants) | GIWGTLAKIGIKAVPRVISMLKKKQ | 957 |
| AP00389 P82426, Ponericin W4 (ants) | GIWGTALKWGVKLLPKLVGMAQTKKQ | 958 |
| AP00390 P82427, Ponericin W5 (ants) | FWGALIKGAAKLIPSVVGLFKKKQ | 959 |
| AP00391 P82428, Ponericin W6 (ants) | FIGTALGIASAIPAIVKLFK | 960 |
| AP00303 P82651, Tigerinin-1 (frog) | FCTMIPIPRCY | 961 |
| AP00304 P82652, Tigerinin-2 (frog) | RVCFAIPLPICH | 962 |
| AP00305 P82653, Tigerinin-3 (frog) | RVCYAIPLPICY | 963 |
| AP00301 P82656, Hadrurin (scorpion) | GILDTIKSIASKVWNSKTVQDLKRKGINWVANKLGVSPQAA | 964 |
| AP00113 P82740, RANATUERIN 1T (frog) | GLLSGLKKVGKHVAKNVAVSLMDSLKCKISGDC | 965 |
| AP00114 P82741, RANATUERIN 1 (Ranatuerin-1, frog) | SMLSVLKNLGKVGLGFVACKINKQC | 966 |
| AP00115 P82742, RANATUERIN 2 (Ranatuerin-2, frog) | GLFLDTLKGAAKDVAGKLEGLKCKITGCKLP | 967 |
| AP00116 P82780, RANATUERIN 3 (Ranatuerin-3, frog) | GFLDIINKLGKTFAGHMLDKIKCTIGTCPPSP | 968 |
| AP00117 P82819, RANATUERIN 4 (Ranatuerin-4, frog) | FLPFIARLAAKVFPSIICSVTKKC | 969 |
| AP00405 P82821, RANATUERIN 6 (frog) | FISAIASMLGKFL | 970 |
| AP00406 P82822, RANATUERIN 7 (frog) | FLSAIASMLGKFL | 971 |
| AP00407 P82823, RANATUERIN 8 (frog) | FISAIASFLGKFL | 972 |
| AP00408 P82824, RANATUERIN 9 (frog) | FLFPLITSFLSKVL | 973 |
| AP00461 P82825, Brevinin-1LA (frog) | FLPMLAGLAASMVPKLVCLITKKC | 974 |
| AP00462 P82826, Brevinin-1LB (frog) | FLPMLAGLAASMVPKFVCLITKKC | 975 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00118 P82828, RANATUERIN 2La (Ranatuerin-2La, frog) | GILDSFKGVAKGVAKDLAGKLLDKLK CKITGC | 976 |
| AP00119 P82829, RANATUERIN 2Lb (Ranatuerin-2Lb, frog) | GILSSIKGVAKGVAKNVAAQLLDTLK CKITGC | 977 |
| AP00109 P82830, Temporin-1La (Temporin 1La, frog) | VLPLISMALGKLL | 978 |
| AP00110 P82831, Temporin-1Lb (Temporin 1Lb, frog) | NFLGTLINLAKKIM | 979 |
| AP00111 P82832, Temporin-1Lc (Temporin 1Lc, frog) | FLPILINLIHKGLL | 980 |
| AP00463 P82833, Brevinin-1BA (frog) | FLPFIAGMAAKFLPKIFCAISKKC | 981 |
| AP00464 P82834, Brevinin-1BB (frog) | FLPAIAGMAAKFLPKIFCAISKKC | 982 |
| AP00465 P82835, Brevinin-1BC (frog) | FLPFIAGVAAKFLPKIFCAISKKC | 983 |
| AP00466 P82836, Brevinin-1BD (frog) | FLPAIAGVAAKFLPKIFCAISKKC | 984 |
| AP00467 P82837, Brevinin-1BE (frog) | FLPAIVGAAAKFLPKIFCVISKKC | 985 |
| AP00468 P82838, Brevinin-1BF (frog) | FLPFIAGMAANFLPKIFCAISKKC | 986 |
| AP00120 P82840, RANATUERIN 2B (Ranatuerin-2B, frog) | GLLDTIKGVAKTVAASMLDKLKCKIS GC | 987 |
| AP00469 P82841, Brevinin-1PA (frog) | FLPIIAGVAAKVFPKIFCAISKKC | 988 |
| AP00460 P82842, Brevinin-1PB (frog) | FLPIIAGIAAKVFPKIFCAISKKC | 989 |
| AP00470 P82843, Brevinin-1PC (frog) | FLPIIASVAAKVFSKIFCAISKKC | 990 |
| AP00471 P82844, Brevinin-1PD (frog) | FLPIIASVAANVFSKIFCAISKKC | 991 |
| AP00472 P82845, Brevinin-1PE (frog) | FLPIIASVAAKVFPKIFCAISKKC | 992 |
| AP00121 P82847, RANATUERIN 2P (Ranatuerin-2P, frog) | GLMDTVKNVAKNLAGHMLDKLKCKI TGC | 993 |
| AP00112 P82848, Temporin-1P (Temporin 1P, frog) | FLPIVGKLLSGLL | 994 |
| AP00452 P82871, Brevinin-1SY (frog) | FLPVVAGLAAKVLPSIICAVTKKC | 995 |
| AP00122 P82875, Ranatuerin-1C (Ranatuerin 1C, frog) | SMLSVLKNLGKVGLGLVACKINKQC | 996 |
| AP00514 P82876, Ranalexin-1Ca (frog) | FLGGLMKAFPALICAVTKKC | 997 |
| AP00515 P82877, Ranalexin-1Cb (frog) | FLGGLMKAFPAIICAVTKKC | 998 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00124 P82878, Ranatuerin-2Ca (Ranatuerin 2Ca, frog) | GLFLDTLKGAAKDVAGKLLEGLKCKIAGCKP | 999 |
| AP00123 P82879, Ranatuerin-2Cb (Ranatuerin 2Cb, frog) | GLFLDTLKGLAGKLLQGLKCIKAGCKP | 1000 |
| AP00104 P82880, Temporin-1Ca (Temporin 1Ca, frog) | FLPFLAKILTGVL | 1001 |
| AP00105 P82881, Temporin-1Cb (Temporin 1Cb, frog) | FLPLFASLIGKLL | 1002 |
| AP00106 P82882, Temporin-1Cc (Temporin 1Cc, frog) | FLPFLASLLTKVL | 1003 |
| AP00107 P82883, Temporin-1Cd (Temporin 1Cd, frog) | FLPFLASLLSKVL | 1004 |
| AP00108 P82884, Temporin-1Ce (Temporin 1Ce, frog) | FLPFLATLLSKVL | 1005 |
| AP00453 P82904, Brevinin-1SA (frog) | FLPAIVGAAGQFLPKIFCAISKKC | 1006 |
| AP00454 P82905, Brevinin-1SB (frog) | FLPAIVGAAGKFLPKIFCAISKKC | 1007 |
| AP00455 P82906, Brevinin-1SC (frog) | FFPIVAGVAGQVLKKIYCTISKKC | 1008 |
| AP00996 P82907, Lichenin (bacteria) | ISLEICAIFHDN | 1009 |
| AP00302 P82951, Hepcidin (fish) | GCRFCCNCCPNMSGCGVCCRF | 1010 |
| AP00058 P83080, Maximin 1 (toad) | GIGTKILGGVKTALKGALKELASTYAN | 1011 |
| AP00059 P83081, Maximin 2 (toad) | GIGTKILGGVKTALKGALKELASTYVN | 1012 |
| AP00060 P83082, Maximin 3 (toad, ZZHa) | GIGGKILSGLKTALKGAAKELASTYLH | 1013 |
| AP00061 P83083, Maximin 4 (toad) | GIGGVLLSAGKAALKGLAKVLAEKYAN | 1014 |
| AP00062 P83084, Maximin 5 (toad) | SIGAKILGGVKTFFKGALKELASTYLQ | 1015 |
| AP00063 P83085, Maximin 6 (toad) | ILGPVISTIGGVLGGLLKNL | 1016 |
| AP00064 P83086, Maximin 7 (toad) | ILGPVLGLVGNALGGLIKNE | 1017 |
| AP00065 P83087, Maximin 8 (toad) | ILGPVLSLVGNALGGLLKNE | 1018 |
| AP00355 P83171, Ginkbilobin (Chinese plant) | ANTAFVSSAHNTQKIPAGAPFNRNLRAMLADLRQNAAFAG | 1019 |
| AP00475 P83188, Pseudin 1 (frog) | GLNTLKKVFQGLHEAIKLINNHVQ | 1020 |
| AP00476 P83189, Pseudin 2 (frog) | GLNALKKVFQGIHEAIKLINNHVQ | 1021 |
| AP00477 P83190, Pseudin 3 (frog) | GINTLKKVIQGLHEVIKLVSNHE | 1022 |
| AP00478 P83191, Pseudin 4 (frog) | GINTLKKVIQGLHEVIKLVSNHA | 1023 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00410 P83287, Oncorhyncin III (fish) | SKGKKANKDVELARG | 1024 |
| AP00357 P83305, Japonicin-1 (amphibian, frog) | FFPIGVFCKIFKTC | 1025 |
| AP00358 P83306, Japonicin-2 (amphibian, frog) | FGLPMLSILPKALCILLKRKC | 1026 |
| AP00385 P83312, Parabutoporin (scorpion) | FKLGSFLKKAWKSKLAKKLRAKGKE MLKDYAKGLLEGGSEEVPGQ | 1027 |
| AP00374 P83313, Opistoporin 1 (scorpion) | GKVWDWIKSTAKKLWNSEPVKELKN TALNAAKNLVAEKIGATPS | 1028 |
| AP00375 P83314, Opistoporin 2 (scorpion) | GKVWDWIKSTAKKLWNSEPVKELKN TALNAAKNFVAEKIGATPS | 1029 |
| AP00336 P83327, Histone H2A (fish) | AERVGAGAPVYL | 1030 |
| AP00335 P83338, Histone H6-like protein (fish) | PKRKSATKGDEPA | 1031 |
| AP00411 P83374, Oncorhyncin II (fish) | KAVAAKKSPKKAKKPAT | 1032 |
| AP00999 P83375, Serracin-P 43 kDa subunit (bacteria) | DYHHGVRVL | 1033 |
| AP00284 P83376, Dolabellanin B2 (sea hare) | SHQDCYEALHKCMASHSKPFSCSMKF HMCLQQQ | 1034 |
| AP00998 P83378, Serracin-P 23 kDa subunit (bacteriocin, bacteria) | ALPKKLKYLNLFNDGFNYMGVV | 1035 |
| AP00129 P83403, Cecropin (insect, moth) | GWLKKIGKKIERVGQNTRDATVKGLE VAQQAANVAATVR | 1036 |
| AP00127 P83413, Cecropin A (insect, moth) | RWKVFKKIEKVGRNIRDGVIKAAPAIE VLGQAKAL | 1037 |
| AP00372 P83416, Virescein (insect) | GKIPIGAIKKAGKAIGKGLRAVNIAST AHDVYTFFKPKKRH | 1038 |
| AP00356 P83427, Heliocin (insect) | QRFIHPTYRPPPQPRRPVIMRA | 1039 |
| AP00409 P83428, Locustin (insect) | ATTGCSCPQCIIFDPICASSYKNGRRGF SSGCHMRCYNRCHGTDYFQISKGSKCI | 1040 |
| AP00339 P83545, Chrysophsin-1 (Red sea bream, madai) | FFGWLIKGAIHAGKAIHGLIHRRRH | 1041 |
| AP00340 P83546, Chrysophsin-2 (Red sea bream, madai) | FFGWLIRGAIHAGKAIHGLIHRRRH | 1042 |
| AP00341 P83547, Chrysophsin-3 (Red sea bream, madai) | FIGLLISAGKAIHDLIRRRH | 1043 |
| AP01004 P84763, Thuricin-S (bacteria) | DWTAWSALVAAACSVELL | 1044 |
| AP00553 P84868, Sesquin (plant, ZZHp) | KTCENLADTY | 1045 |
| AP00132 Q06589, Cecropin 1 (insect, fly) | GWLKKIGKKIERVGQHTRDATIQTIAV AQQAANVAATAR | 1046 |
| AP00135 Q06590, Cecropin 2 (insect fly) | GWLKKIGKKIERVGQHTRDATIQTIGV AQQAANVAATLK | 1047 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00416 Q17313, Ceratotoxin C (insect, fly) | SLGGVISGAKKVAKVAIPIGKAVLPVV AKLVG | 1048 |
| AP00171 Q24395, Metchnikowin (insect) | HRHQGPIFDTRPSPFNPNQPRPGPIY | 1049 |
| AP00354 Q27023, Tenecin 1 (insect) | VTCDILSVEAKGVKLNDAACAAHCLF RGRSGGYCNGKRVCVCR | 1050 |
| AP00401 Q28880, Lingual antimicrobial peptide (LAP, beta defensin, cow) | GFTQGVRNSQSCRRNKGICVPIRCPGS MRQIGTCLGAQVKCCRRK | 1051 |
| AP00224 Q62713, RatNP-3 (rat) | CSCRTSSCRFGERLSGACRLNGRIYRL CC | 1052 |
| AP00225 Q62714, RatNP-4 (rat) | ACYCRIGACVSGERLTGACGLNGRIY RLCCR | 1053 |
| AP00223 Q62715, RatNP-2 (rat) | VTCYCRSTRCGFRERLSGACGYRGRI YRLCCR | 1054 |
| AP00222 Q62716, RatNP-1 (rat) | VTCYCRRTRCGFRERLSGACGYRGRI YRLCCR | 1055 |
| AP00174 Q64365, GNCP-1 (Guinea pig neutrophil cationic peptide 1) | RRCICTTRTCRFPYRRLGTCIFQNRVY TFCC | 1056 |
| AP00311 Q90W78, Galensin (frog) | CYSAAKYPGFQEFINRKYKSSRF | 1057 |
| AP00395 Q95NT0, Penaeidin-4a (shrimp, Crustacea) | HSSGYTRPLPKPSRPIFIRPIGCDVCYGI PSSTARLCCFRYGDCCHR | 1058 |
| AP00423 Q962B0, Penaeidin-3n (shrimp, Crustacea) | QGYKGPYTRPILRPYVRPVVSYNACT LSCRGITTTQARSCSTRLGRCCHVAKG YS | 1059 |
| AP00422 Q962B1, Penaeidin-3m (shrimp, Crustacea) | QGCKGPYTRPILRPYVRPVVSYNACT LSCRGITTTQARSCCTRLGRCCHVAK GYS | 1060 |
| AP00421 Q963C3, Penaeidin-4C (shrimp, Crustacea) | YSSGYTRPLPKPSRPIFIRPIGCDVCYGI PSSTARLCCFRYGDCCHR | 1061 |
| AP00210 Q99134, PGLa (African clawed frog, XXA) | GMASKAGAIAGKIAKVALKAL | 1062 |
| AP00054 Q9DET7, Bombinin-like peptide 7 (BLP-7, toad) | GIGGALLSAGKSALKGLAKGLAEHFAN | 1063 |
| AP00315 Q9PT75, Dermatoxin (Two-colored leaf frog) | SLGSFLKGVGTTLASVGKVVSDQFGK LLQAGQ | 1064 |
| AP00133 Q9Y0Y0, Cecropin B (insect, mosquito) | GGLKKLGKKLEGVGKRVFKASEKAL PVLTGYKAIG | 1065 |
| AP00004 Ref, Ct-AMP1 (CtAMP1, C. ternatea-antimicrobial peptide 1, plant defensin) | NLCERASLTWTGNCGNTGHCDTQCR NWESAKHGACHKRGNWKCFCYFDC | 1066 |
| AP00027 Ref, hexapeptide (synthetic) | RRWQWR | 1067 |
| AP00529 Ref, Lantibiotic Ericin S (bacteria) | WKSESVCTPGCVTGVLQTCFLQTITC NCHISK | 1068 |
| AP00306 Ref, Tigerinin-4 (frog) | RVCYAIPLPIC | 1069 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00309 Ref, Human KS-27 (KS27 from LL-37) | KSKEKIGKEFKRIVQRIKDFLRNLVPR | 1070 |
| AP00344 Ref, Apidaecin II (honeybee, insect) | GNNRPIYIPQPRPPHPRL | 1071 |
| AP00424 Ref, XT1 (frog) | GFLGPLLKLAAKGVAKVIPHLIPSRQQ | 1072 |
| AP00425 Ref, XT 2 (frog) | GCWSTVLGGLKKFAKGGLEAIVNPK | 1073 |
| AP00426 Ref, XT 4 (frog) | GVFLDALKKFAKGGMNAVLNPK | 1074 |
| AP00427 Ref, XT 7 (frog) | GLLGPLLKIAAKVGSNLL | 1075 |
| AP00431 Ref, human LLP 1 | RVIEVVQGACRAIRHIPRRIRQGLERIL | 1076 |
| AP00432 Ref, human LLP | RIAGYGLRGLAVIIRICIRGLNLIFEIIR | 1077 |
| AP00447 Ref, Anoplin (insect) | GLLKRIKTLL | 1078 |
| AP00474 Ref, Piscidin 3 (fish) | FIHHIFRGIVHAGRSIGRFLTG | 1079 |
| AP00481 Ref, Kaliocin-1 (synthetic) | FFSASCVPGADKGQFPNLCRLCAGTGENKCA | 1080 |
| AP00482 Ref, Thionin mutation (synthetic) | KSCCRNTWARNCYNVCRLPGTISREICAKKCRCKIISGTTCPSDYPK | 1081 |
| AP00484 Ref, Stomoxyn (insect, fly) | RGFRKHFNKLVKKVKHTISETAHVAKDTAVIAGSGAAVVAAT | 1082 |
| AP00486 Ref, Cupiennin 1b (spider) | GFGSLFKFLAKKVAKTVAKQAAKQGAKYIANKQME | 1083 |
| AP00487 Ref, Cupiennin 1c (spider) | GFGSLFKFLAKKVAKTVAKQAAKQGAKYIANKQTE | 1084 |
| AP00488 Ref, Cupiennin 1D (spider) | GFGSLFKFLAKKVAKTVAKQAAKQGAKYVANKHME | 1085 |
| AP00489 Ref, Hipposin (fish) | SGRGKTGGKARAKAKTRSSRAGLQFPVGRVHRLLRKGNYAHRVGAGAPVYL | 1086 |
| AP00923 Ref, Carnobacteriocin B1 (XXO, class IIa bacteriocin, bacteria) | AISYGNGVYCNKEKCWVNKAENKQAITGIVIGGWASSLAGMGH | 1087 |
| AP00496 Ref, HP 2-20 (synthetic) | AKKVFKRLEKLFSKIQNDK | 1088 |
| AP00497 Ref, Maximin H5 (toad) | ILGPVLGLVSDTLDDVLGIL | 1089 |
| AP00498 Ref, rCRAMP (rat cathelicidin) | GLVRKGGEKFGEKLRKIGQKIKEFFQKLALEIEQ | 1090 |
| AP00500 Ref, S9-P18 (synthetic) | KWKLFKKISKFLHLAKKF | 1091 |
| AP00501 Ref, L9-P18 (synthetic) | KWKLFKKILKFLHLAKKF | 1092 |
| AP00502 Ref, Clavaspirin (sea squirt, tunicate) | FLRFIGSVIHGIGHLVHHIGVAL | 1093 |
| AP00503 Ref, human P-113D | AKRHHGYKRKFH | 1094 |
| AP00504 Ref, human MUC7 20-Mer | LAHQKPFIRKSYKCLHKRCR | 1095 |
| AP00507 Ref, Nigrocin 2 (frog) | GLLSKVLGVGKKVLCGVSGLC | 1096 |
| AP00508 Ref, Nigrocin 1 (frog) | GLLDSIKGMAISAGKGALQNLLKVASCKLDKTC | 1097 |
| AP00509 Ref, human Calcitermin | VAIALKAAHYHTHKE | 1098 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00510 Ref, Dicynthaurin (sea peach) | ILQKAVLDCLKAAGSSLSKAAITAIYNKIT | 1099 |
| AP00511 Ref, KIGAKI (synthetic) | KIGAKIKIGAKIKIGAKI | 1100 |
| AP00516 Ref, Lycotoxin I (spider) | IWLTALKFLGKHAAKHLAKQQLSKL | 1101 |
| AP00517 Ref, Lycotoxin II (spider) | KIKWFKTMKSIAKFIAKEQMKKHLGGE | 1102 |
| AP00518 Ref, Ib-AMP3 (plant defensin, balsam) | QYRHRCCAWGPGRKYCKRWC | 1103 |
| AP00519 Ref, Ib-AMP4 (plant defensin, balsam) | EWGRRCCGWGPGRRYCRRWC | 1104 |
| AP00521 Ref, Dhvar4 (synthetic) | KRLFKKLLFSLRKY | 1105 |
| AP00522 Ref, Dhvar5 (synthetic) | LLLFLLKKRKKRKY | 1106 |
| AP00525 Ref, Maximin H2 (toad) | ILGPVLSMVGSALGGLIKKI | 1107 |
| AP00526 Ref, Maximin H3 (toad) | ILGPVLGLVGNALGGLIKKI | 1108 |
| AP00527 Ref, Maximin H4 (toad) | ILGPVISKIGGVLGGLLKNL | 1109 |
| AP00528 Ref, Anionic peptide SAAP (sheep) | DDDDDD | 1110 |
| AP00530 Ref, Lantibiotic Ericin A (bacteria) | VLSKSLCTPGCITGPLQTCYLCFPTFAKC | 1111 |
| AP00531 Ref, Kenojeinin I (sea skate) | GKQYFPKVGGRLSGKAPLAAKTHRRLKP | 1112 |
| AP00532 Ref, Lunatusin (plant, ZZHp) | KTCENLADTFRGPCFATSNC | 1113 |
| AP00533 Ref, Fallaxin (frog) | GVVDILKGAAKDIAGHLASKVMNKL | 1114 |
| AP00534 Ref, Tu-AMP 2 (TuAMP2, thionin-like antimicrobial peptides, plant defensin, tulip) | KSCCRNTTARNCYNVCRIPG | 1115 |
| AP00535 Ref, Pilosulin 1 (Myr b I) (Australian ants) | GLGSVFGRLARILGRVIPKVAKKLGPKVAKVLPKVMKEAIPMAVEMAKSQEEQQPQ | 1116 |
| AP00536 Ref, Luxuriosin (insect) | SVRTQDNAVNRQIFGSNGPYRDFQLSDCYLPLETNPYCNEWQFAYHWNNALMDCERAIYHGCNRTRNNFITLTACKNQAGPICNRRH | 1117 |
| AP00537 Ref, SAMP H1 (fish, Atlantic salmon) | AEVAPAPAAAAPAKAPKKKAAAKPKKAGPS | 1118 |
| AP00538 Ref, Halocidin (dimer Hal18 + Hal15) (tunicate) | WLNALLHHGLNCAKGVLA | 1119 |
| AP00539 Ref, AOD (American oyster defensin, animal defensin) | GFGCPWNRYQCHSHCRSIGRLGGYCAGSLRLTCTCYRS | 1120 |
| AP00540 Ref, Pentadactylin (frog) | GLLDTLKGAAKNVVGSLASKVMEKL | 1121 |
| AP00541 Ref, Polybia-MPI (insect, social wasp) | IDWKKLLDAAKQIL | 1122 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00542 Ref, Polybia-CP (insect, social wasp) | ILGTILGLLKSL | 1123 |
| AP00543 Ref, Ocellatin-1 (XXA, frog) | GVVDILKGAGKDLLAHLVGKISEKV | 1124 |
| AP00544 Ref, Ocellatin-2 (XXA, frog) | GVLDIFKDAAKQILAHAAEKQI | 1125 |
| AP00545 Ref, Ocellatin-3 (frog) | GVLDILKNAAKNILAHAAEQI | 1126 |
| AP00548 Ref, CMAP 27 (chicken myeloid antimicrobial peptide 27, bird cathelicidin, chicken cathelicidin) | RFGRFLRKIRRFRPKVTITIQGSARFG | 1127 |
| AP00550 Ref, Tu-AMP-1 (TuAMP 1, thionin-like antimicrobial peptides, plant defensin, tulip) | KSCCRNTVARNCYNVCRIPGTPRPVC AATCDCKLITGTKCPPGYEK | 1128 |
| AP00551 Ref, Combi-2 (synthetic) | FRWWHR | 1129 |
| AP00552 Ref, Maximin 9 (frog) | GIGRKFLGGVKTTFRCGVKDFASKHLY | 1130 |
| AP00554 Ref, S1 moricin (insect) | GKIPVKAIKKAGAAIGKGLRAINIAST AHDVYSFFKPKHKKK | 1131 |
| AP00555 Ref, Parasin I (catfish) | KGRGKQGGKVRAKAKTRSS | 1132 |
| AP00556 Ref, Kassinatuerin-1 (frog) | GFMKYIGPLIPHAVKAISDLI | 1133 |
| AP00557 Ref, Fowlicidin-1 (chCATH-1, bird cathelicidin, chicken cathelicidin) | RVKRVWPLVIRTVIAGYNLYRAIKKK | 1134 |
| AP00559 Ref, Eryngin (mushroom, fungi) | ATRVVYCNRRSGSVVGGDDTVYYEG | 1135 |
| AP00560 Ref, Dendrocin (plant, bamboo) | TTLTLHNLCPYPVWWLVTPNNGGFPII DNTPVVLG | 1136 |
| AP00561 Ref, Coconut antifungal peptide (plant) | EQCREEEDDR | 1137 |
| AP00562 Ref, Pandinin 1 (African scorpion) | GKVWDWIKSAAKKIWSSEPVSQLKG QVLNAAKNYVAEKIGATPT | 1138 |
| AP00563 Ref, White cloud bean defensin (plant defensin) | KTCENLADTFRGPCFATSNCDDHCKN KEHLLSGRCRDDFRCWCTRNC | 1139 |
| AP00564 Ref, Dybowskin-1 (frog) | FLIGMTHGLICLISRKC | 1140 |
| AP00565 Ref, Dybowskin-2 (frog) | FLIGMTQGLICLITRKC | 1141 |
| AP00566 Ref, Dybowskin-3 (frog) | GLFDVVKGVLKGVGKNVAGSLLEQL KCKLSGGC | 1142 |
| AP00567 Ref, Dybowskin-4 (frog) | VWPLGLVICKALKIC | 1143 |
| AP00568 Ref, Dybowskin-5 (frog) | GLFSVVTGVLKAVGKNVAKNVGGSL LEQLKCKKISGGC | 1144 |
| AP00569 Ref, Dybowskin-6 (frog) | FLPLLLAGLPLKLCFLFKKC | 1145 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00570 Ref, Pleurain-A1 (frog) | SIITMTKEAKLPQLWKQIACRLYNTC | 1146 |
| AP00571 Ref, Pleurain-A2 (frog) | SIITMTKEAKLPQSWKQIACRLYNTC | 1147 |
| AP00574 Ref, Esculentin-IGRa (frog) | GLFSKFAGKGIKNLIFKGVKHIGKEVG MDVIRTGIDVAGCKIKGEC | 1148 |
| AP00575 Ref, Brevinin-2GRa (frog) | GLLDTFKNLALNAAKSAGVSVLNSLS CKLSKTC | 1149 |
| AP00576 Ref, Brevinin-2GRb (frog) | GVLGTVKNLLIGAGKSAAQSVLKTLS CKLSNDC | 1150 |
| AP00577 Ref, Brevinin-2GRc (frog) | GLFTLIKGAAKLIGKTVAKEAGKTGLE LMACKITNQC | 1151 |
| AP00578 Ref, Brevinin-1GRa (frog) | FLPLLAGLAANFLPKIFCKITKKC | 1152 |
| AP00579 Ref, Nigrocin-2GRa (frog) | GLLSGILGAGKHIVCGLSGLC | 1153 |
| AP00580 Ref, Nigrocin-2GRb (frog) | GLFGKILGVGKKVLCGLSGMC | 1154 |
| AP00581 Ref, Nigrocin-2GRc (frog) | GLLSGILGAGKNIVCGLSGLC | 1155 |
| AP00582 Ref, Brevinin-2GHa (frog) | GFSSLFKAGAKYLLKSVGKAGAQQLA CKAANNCA | 1156 |
| AP00583 Ref, Brevinin-2GHb (frog) | GVITDALKGAAKTVAAELLRKAHCKL TNSC | 1157 |
| AP00584 Ref, Guentherin (frog) | VIDDLKKVAKKVRRELLCKKHHKKLN | 1158 |
| AP00585 Ref, Brevinin-2GHc (frog) | SIWEGIKNAGKGFLVSILDKVRCKVA GGCNP | 1159 |
| AP00586 Ref, Temporin-GH (frog) | FLPLLFGAISHLL | 1160 |
| AP00587 Ref, Brevinin-2TSa (frog) | GIMSLFKGVLKTAGKHVAGSLVDQLK CKITGGC | 1161 |
| AP00588 Ref, Brevinin-1TSa (frog) | FLGSIVGALASALPSLISKIRN | 1162 |
| AP00589 Ref, Temporin-1TSa (frog) | FLGALAKIISGIF | 1163 |
| AP00593 Ref, Brevinin-1CSa (frog) | FLPILAGLAAKIVPKLFCLATKKC | 1164 |
| AP00594 Ref, Temporin-1CSa (frog) | FLPIVGKLLSGLL | 1165 |
| AP00595 Ref, Temporin-1CSb (frog) | FLPIIGKLLSGLL | 1166 |
| AP00596 Ref, Temporin-1CSc (frog) | FLPLVTGLLSGLL | 1167 |
| AP00597 Ref, Temporin-1CSd (frog) | NFLGTLVNLAKKIL | 1168 |
| AP00598 Ref, Temporin-1SPb (frog) | FLSAITSLLGKLL | 1169 |
| AP00599 Ref, Brevinin-2-related (frog) | GIWDTIKSMGKVFAGKILQNL | 1170 |
| AP00600 Ref, Odorranain-HP (frog) | GLLRASSVWGRKYYVDLAGCAKA | 1171 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00601 Ref, Brevinin-1DYa (frog) | FLSLALAALPKFLCLVFKKC | 1172 |
| AP00602 Ref, Brevinin-1DYb (frog) | FLSLALAALPKLFCLIFKKC | 1173 |
| AP00603 Ref, Brevinin-1DYc (frog) | FLPLLLAGLPKLLCLFFKKC | 1174 |
| AP00607 Ref, Brevinin-2DYb (frog) | GLFDVVKGVLKGAGKNVAGSLLEQL KCKLSGGC | 1175 |
| AP00608 Ref, Brevinin-2DYc (frog) | GLFDVVKGVLKGVGKNVAGSLLEQL KCKLSGGC | 1176 |
| AP00609 Ref, Brevinin-2DYd (frog) | GIFDVVKGVLKGVGKNVAGSLLEQLK CKLSGGC | 1177 |
| AP00610 Ref, Brevinin-2DYe (frog) | GLFSVVTGVLKAVGKNVAKNVGGSL LEQLKCKISGGC | 1178 |
| AP00611 Ref, Temporin-1DYa (frog) | FIGPIISALASLFG | 1179 |
| AP00615 Ref, Palustrin-1b (frog) | ALFSILRGLKKLGNMGQAFVNCKIYK KC | 1180 |
| AP00616 Ref, Palustrin-1c (frog) | ALSILRGLEKLAKMGIALTNCKATKKC | 1181 |
| AP00617 Ref, Palustrin-1d (frog) | ALSILKGLEKLAKMGIALTNCKATKKC | 1182 |
| AP00619 Ref, Palustrin-2b (frog) | GFFSTVKNLATNVAGTVIDTLKCKVT GGCRS | 1183 |
| AP00620 Ref, Palustrin-2c (frog) | GFLSTVKNLATNVAGTVIDTLKCKVT GGCRS | 1184 |
| AP00621 Ref, Palustrin-3a (frog) | GIFPKIIGKGIKTGIVNGIKSLVKGVGM KVFKAGLNNIGNTGCNEDEC | 1185 |
| AP00622 Ref, Palustrin-3b (frog) | GIFPKIIGKGIKTGIVNGIKSLVKGVGM KVFKAGLSNIGNTGCNEDEC | 1186 |
| AP00624 Ref, human ALL-38 (an LL-37 analog released from its precursor hCAP-18 by gastricsin in vivo) | ALLGDFFRKSKEKIGKEFKRIVQRIKD FLRNLVPRTES | 1187 |
| AP00625 Ref, human KR-20 (KR20 from LL-37) | KRIVQRIKDFLRNLVPRTES | 1188 |
| AP00626 Ref, human KS-30 (KS30 from LL-37) | KSKEKIGKEFKRIVQRIKDFLRNLVPR TES | 1189 |
| AP00627 Ref, human RK-31 (RK31 from LL-37) | RKSKEKIGKEFKRIVQRIKDFLRNLVP RTES | 1190 |
| AP00628 Ref, human LL-23 (LL23 from LL-37) | LLGDFFRKSKEKIGKEFKRIVQR | 1191 |
| AP00629 Ref, human LL-29 (LL29 from LL-37) | LLGDFFRKSKEKIGKEFKRIVQRIKDFLR | 1192 |
| AP00630 Ref, Amoeba peptide (protozoan para | GEILCNLCTGLINTLENLLTTKGAD | 1193 |
| AP00631 Ref, Mundticin (bacteria) | KYYGNGVSCNKKGCSVDWGKAIGIIG NNSAANLATGGAAGWSK | 1194 |
| AP00638 Ref, Citropin 2.1 (frog) | GLIGSIGKALGGLLVDVLKPKL | 1195 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00639 Ref, Citropin 2.1.3 (frog) | GLIGSIGKALGGLLVDVLKPKLQAAS | 1196 |
| AP00640 Ref, Maculatin 1.3 (frog) | GLLGLLGSVVSHVVPAIVGHF | 1197 |
| AP00641 Ref, Pardaxin 1 (Pardaxin P-1, Pardaxin P1, Pa1, flat fish) | GFFALIPKIISSPLFKTLLSAVGSALSSSGEQE | 1198 |
| AP00642 Ref, Pardaxin 2 (Pardaxin P-2, Pardaxin P2, Pa2, flat fish) | GFFALIPKIISSPIFKTLLSAVGSALSSSGGQE | 1199 |
| AP00643 Ref, Pardaxin 3 (Pardaxin P-3, Pardaxin P3, Pa3, flat fish) | GFFAFIPKIISSPLFKTLLSAVGSALSSSGEQE | 1200 |
| AP00645 Ref, Pardaxin 5 (Pardaxin P-5, Pardaxin P5, Pa5, flat fish) | GFFAFIPKIISSPLFKTLLSAVGSALSSSGDQE | 1201 |
| AP00647 Ref, Brevinin-1PLb (frog) | FLPLIAGLAANFLPKIFCAITKKC | 1202 |
| AP00648 Ref, Brevinin-1PLc (frog) | FLPVIAGVAAKFLPKIFCAITKKC | 1203 |
| AP00649 Ref, Esculentin-1PLa (frog) | GLFPKINKKKAKTGVFNIIKTVGKEAGMDLIRTGIDTIGCKIKGEC | 1204 |
| AP00650 Ref, Esculentin-1PLb (frog) | GIFTKINKKKAKTGVFNIIKTIGKEAGMDVIRAGIDTISCKIKGEC | 1205 |
| AP00651 Ref, Esculentin-2PLa (frog) | GLFSILKGVGKIALKGLAKNMGKMGLDLVSCKISKEC | 1206 |
| AP00652 Ref, Ranatuerin-2PLa (frog) | GIMDTVKNVAKNLAGQLLDKLKCKITAC | 1207 |
| AP00653 Ref, Ranatuerin-2PLb (frog) | GIMDTVKNAAKDLAGQLLDKLKCRITGC | 1208 |
| AP00654 Ref, Ranatuerin-2PLc (frog) | GLLDTIKNTAKNLAVGLLDKIKCKMTGC | 1209 |
| AP00655 Ref, Ranatuerin-2PLd (frog) | GIMDSVKNVAKNIAGQLLDKLKCKITGC | 1210 |
| AP00656 Ref, Ranatuerin-2PLe (frog) | GIMDSVKNAAKNLAGQLLDTIKCKITAC | 1211 |
| AP00657 Ref, Ranatuerin-2PLf (frog) | GIMDTVKNAAKDLAGQLDKLKCRITGC | 1212 |
| AP00658 Ref, Temporin-1PLa (frog) | FLPLVGKILSGLI | 1213 |
| AP00659 Ref, Ranatuerin 5 (frog) | FLPIASLLGKYL | 1214 |
| AP00661 Ref, Esculentin-2L (frog) | GILSLFTGGIKALGKTLFKMAGKAGAEHLACKATNQC | 1215 |
| AP00662 Ref, Esculentin-2B (ESC2B-RANBE, frog) | GLFSILRGAAKFASKGLGKDLTKLGVDLVACKISKQC | 1216 |
| AP00663 Ref, Esculentin-2P (frog) | GFSSIFRGVAKFASKGLGKDLARLGVNLVACKISKQC | 1217 |
| AP00664 Ref, Peptide A1 (frog) | FLPAIAGILSQLF | 1218 |
| AP00665 Ref, Peptide B9 (frog) | FLPLIAGLIGKLF | 1219 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00666 Ref, PG-L (frog) | EGGGPQWAVGHFM | 1220 |
| AP00667 Ref, PG-KI (frog) | EPHPDEFVGLM | 1221 |
| AP00668 Ref, PG-KII (frog) | EPNPDEFVGLM | 1222 |
| AP00669 Ref, PG-KIII (frog) | EPHPNEFVGLM | 1223 |
| AP00670 Ref, PG-SPI (frog) | EPNPDEFFGLM | 1224 |
| AP00660 Ref, Pandinin 2 (African scorpion) | FWGALAKGALKLIPSLFSSFSKKD | 1225 |
| AP00671 Ref, PG-SPII (frog) | EPNPNEFFGLM | 1226 |
| AP00673 Ref, Lantibiotic Ericin S (bacteria | WKSESVCTPGCVTGVLQTCFLQTITCNCHISK | 1227 |
| AP00674 Ref, Lantibiotic Ericin A (bacteria | VLSKSLCTPGCITGPLQTCYLCFPTFAKC | 1228 |
| AP00675 Ref, Human beta defensin 4 (HBD-4, HBD4, human defensin) | FELDRICGYGTARCRKKCRSQEYRIGRCPNTYACCLRKWDESLLNRTKP | 1229 |
| AP00676 Ref, RL-37 (RL37, monkey cathelicidin) | RLGNFFRKVKEKIGGGLKKVGQKIKDFLGNLVPRTAS | 1230 |
| AP00677 Ref, CAP11 (Guinea pig cathelicidin) | GLRKKFRKTRKRIQKLGRKIGKTGRKVWKAWREYGQIPYPCRI | 1231 |
| AP00678 Ref, Canine cathelicidin (K9CATH) (dog) | RLKELITTGGQKIGEKIRRIGQRIKDFFKNLQPREEKS | 1232 |
| AP00679 Ref, Esculentin 2VEb (frog) | GLFSILKGVGKIAIKGLGKNLGKMGLDLVSCKISKEC | 1233 |
| AP00680 Ref, SMAP-34 (sheep cathelicidin) | GLFGRLRDSLQRGGQKILEKAERIWCKIKDIFR | 1234 |
| AP00681 Ref, OaBac5 (sheep cathelicidin) | RFRPPIRRPPIRPPFRPPFRPPVRPPIRPPFRPPFRPPIGPFP | 1235 |
| AP00682 Ref, OaBac6 (sheep cathelicidin) | RRLRPRHQHFPSERPWPKPLPLPLRPGPRPWPKPLPLPLPRPGLRPWPKPL | 1236 |
| AP00683 Ref, OaBac7.5 (sheep cathelicidin) | RRLRPRRPRLPRPRPRPRPRSLPLRPQPRRIPRPILLPWRPPRPIPRPQIQPIPRWL | 1237 |
| AP00684 Ref, OaBac11 (sheep cathelicidin) | RRLRPRRPRLPRPRPRPRPRSLPLRPKPRPIPRPLPLPRPRPKPIPRPLPLPRPRPRRIPRPLPLPRPRPRPIPRPLPLPQPQPSPIPRPL | 1238 |
| AP00685 Ref, Ranatuerin 2VEb (frog) | GIMDTVKGVAKTVAASLLDKLKCKITGC | 1239 |
| AP00686 Ref, eCATH-1 (horse cathelicidin) | KRFGRLAKSFLRMRILLPRRKILLAS | 1240 |
| AP00687 Ref, eCATH-2 (horse cathelicidin) | KRRHWFPLSFQEFLEQLRRFRDQLPFP | 1241 |
| AP00688 Ref, eCATH-3 (horse cathelicidin) | KRFHSVGSLIQRHQQMIRDKSEATRHGIRIITRPKLLLAS | 1242 |
| AP00689 Ref, Prophenin-1 (pig cathelicidin) | AFPPPNVPGPRFPPPNFPGPRFPPPNFPGPRFPPPNFPGPRFPPPNFPGPPFPPPIFPGPWFPPPPPFRPPPFGPPRFP | 1243 |
| AP00690 Ref, Prophenin-2 (pig cathelicidin) | AFPPPNVPGPRFPPPNVPGPRFPPPNFPGPRFPPPNFPGPRFPPPNFPGPPFPPPIFPGPWFPPPPPFRPPPFGPPRFP | 1244 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00691 Ref, HFIAP-1 (hagfish cathelicidin) | GFFKKAWRKVKHAGRRVLDTAKGV GRHYVNNWLNRYR | 1245 |
| AP00692 Ref, HFIAP-3 (hagfish cathelicidin) | GWFKKAWRKVKNAGRRVLKGVGIH YGVGLI | 1246 |
| AP00693 Ref, Trout cath (fish cathelicidin) | RICSRDKNCVSRPGVGSIIGRPGGGSLI GRPGGGSVIGRPGGGSPPGGGSFNDEF IRDHSDGNRFA | 1247 |
| AP00694 Ref, MRP (melittin-related peptide) | AIGSILGALAKGLPTLISWIKNR | 1248 |
| AP00695 Ref, Temporin-1TGa (frog) | FLPILGKLLSGIL | 1249 |
| AP00696 Ref, Dahlein 1.1 (frog) | GLFDIIKNIVSTL | 1250 |
| AP00697 Ref, Dahlein 1.2 (frog) | GLFDIIKNIFSGL | 1251 |
| AP00698 Ref, Dahlein 4.1 (frog) | GLWQLIKDKIKDAATGFVTGIQS | 1252 |
| AP00699 Ref, Dahlein 4.2 (frog) | GLWQFIKDKLKDAATGLVTGIQS | 1253 |
| AP00700 Ref, Dahlein 4.3 (frog) | GLWQFIKDKFKDAATGLVTGIQS | 1254 |
| AP00701 Ref, Dahlein 5.1 (frog) | GLLGSIGNAIGAFIANKLKP | 1255 |
| AP00702 Ref, Dahlein 5.2 (frog) | GLLGSIGNAIGAFIANKLKPK | 1256 |
| AP00703 Ref, Dahlein 5.3 (frog) | GLLASLGKVLGGYLAEKLKP | 1257 |
| AP00704 Ref, Dahlein 5.4 (frog) | GLLGSIGKVLGGYLAEKLKPK | 1258 |
| AP00705 Ref, Dahlein 5.5 (frog) | GLLASLGKVLGGYLAEKLKPK | 1259 |
| AP00706 Ref, Dahlein 5.6 (frog) | GLLASLGKVFGGYLAEKLKPK | 1260 |
| AP00709 Ref, Mytilus defensin (mytilin) A (mollusc) | GFGCPNDYPCHRHCKSIPGRAGGYCG GAHRLRCTCYR | 1261 |
| AP00711 Ref, Mussel defensin MGD2 | GFGCPNNYACHQHCKSIRGYCGGYC AGWFRLRCTCYRCG | 1262 |
| AP00712 Ref, scorpion defensin | GFGCPLNQGACHRHCRSIRRRGGYCA GFFKQTCCYRN | 1263 |
| AP00713 Ref, Androctonus defensin | GFGCPFNQGACHRHCRSIRRRGGYCA GLFKQTCTCYR | 1264 |
| AP00714 Ref, Orinthodoros defensin A (soft ticks) | GYGCPFNQYQCHSHCSGIRGYKGGYC KGTFKQTCKCY | 1265 |
| AP00715 Ref, VaD1 (plant defensin) | RTCMKKEGWGKCLIDTTCAHSCKNR GYIGGNCKGMTRTCYCLVNC | 1266 |
| AP00722 Ref, Cryptonin (insect, cicada) | GLLNGLALRLGKRALKKIIKRLCR | 1267 |
| AP00723 Ref, Decoralin (insect) | SLLSLLRKLIT | 1268 |
| AP00724 Ref, RTD-2 (rhesus theta-defensin-2, minidefensin, XXC, BBS, lectin, ZZHa) | RCLCRRGVCRCLCRRGVC | 1269 |
| AP00725 Ref, RTD-3 (rhesus theta-defensin-3, minidefensin, XXC, BBS, lectin, ZZHa) | RCICTRGFCRCICTRGFC | 1270 |
| AP00726 Ref, Combi-1 (synthetic) | RRWWRF | 1271 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00748 Ref, Gm pro-rich pept1 (insect) | DIQIPGIKKPTHRDIIIPNWNPNVRTQP WQRFGGNKS | 1272 |
| AP00749 Ref, Gm anionic pept 1 (insect) | EADEPLWLYKGDNIERAPTTADHPILP SIIDDVKLDPNRRYA | 1273 |
| AP00750 Ref, Gm pro-rich pept 2 (insect) | EIRLPEPFRFPSPTVPKPIDIDPILPHPWS PRQTYPIIARRS | 1274 |
| AP00752 Ref, Gm defensin-like peptide (insect) | DKLIGSCVWGATNYTSDCNAECKRR GYKGGHCGSFWNVNCWCEE | 1275 |
| AP00753 Ref, Gm apolipophoricin (insect) | VQETQKLAKTVGANLEETNKKLAPQI KSAYDDFVKQAQEVQKKLHEAASKQ | 1276 |
| AP00754 Ref, Gm anionic pept2 (insect) | ETESTPDYLKNIQQQLEEYTKNFNTQV QNAFDSDKIKSEVNNFIESLGKILNTE KKEAPK | 1277 |
| AP00755 Ref, Gm cecropin D-like pept, insect | ENFFKEIERAGQRIRDAIISAAPAVETL AQAQKIIKGGD | 1278 |
| AP00756 Ref, Dermaseptin-B6 (DRS-B6, DRS B6, XXA, frog) | ALWKDILKNAGKAALNEINQLVNQ | 1279 |
| AP00759 Ref, Phylloseptin-O1 (PLS-O1, Phylloseptin-4, PS-4, XXA, frog) | FLSLIPHAINAVSTLVHHSG | 1280 |
| AP00760 Ref, Phylloseptin-O2 (PLS-O2, Phylloseptin-5, PS-5, XXA, frog) | FLSLIPHAINAVSAIAKHS | 1281 |
| AP00761 Ref, Phylloseptin-6 (Phylloseptin-H4, PLS-H4, PS-6, XXA, frog) | SLIPHAINAVSAIAKHF | 1282 |
| AP00762 Ref, Phylloseptin-7 (Phylloseptin-H5, PLS-H5, PS-7, XXA, frog) | FLSLIPHAINAVSAIAKHF | 1283 |
| AP00763 Ref, Dermaseptin DPh-1 (XXA, frog) | GLWSTIKNVGKEAAIAAGKAALGAL | 1284 |
| AP00764 Ref, Dermaseptin-S9 (DRS-S9, DRS S9, frog) | GLRSKIWLWVLLMIWQESNKFKKM | 1285 |
| AP00765 Ref, Human salvic | MHDFWVLWVLLEYIYNSACSVLSATS SVSSRVLNRSLQVKVVKITN | 1286 |
| AP00766 Ref, Gassericin A (XXC, XXD2, class IV bacteriocin, Gram-positive bacteria) | IYWIADQFGIHLATGTARKLLDAMAS GASLGTAFAAILGVTLPAWALAAAGA LGATAA | 1287 |
| AP00767 Ref, Circularin A (XXC, class IV bacteriocin, Gram-positive bacteria) | VAGALGVQTAAATTIVNVILNAGTLV TVLGIIASIASGGAGTLMTIGWATFKA TVQKLAKQSMARAIAY | 1288 |
| AP00768 Ref, Closticin 574 (bacteria) | PNWTKIGKCAGSIAWAIGSGLFGGAK LIKIKKYIAELGGLQKAAKLLVGATT WEEKLHAGGYALINLAAELTGVAGIQ ANCF | 1289 |
| AP00769 Ref, Caerin 1.11 (XXA, frog) | GLLGAMFKVASKVLPHVVPAITEHF | 1290 |
| AP00770 Ref, Maculatin 1.4 (XXA, frog) | GLLGLLGSVVSHVLPAITQHL | 1291 |
| AP00771 Ref, Magainin 1 (frog) | GIGKFLHSAGKFGKAFVGEIMKS | 1292 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00772 Ref, Oxyopinin 1 (spider) | FRGLAKLLKIGLKSFARVLKKVLPKAAKAGKALAKSMADENAIRQQNQ | 1293 |
| AP00773 Ref, Oxyopinin 2a (spider) | GKFSVFGKILRSIAKVFKGVGKVRKQFKTASDLDKNQ | 1294 |
| AP00774 Ref, Oxyopinin 2b (spider) | GKFSGFAKILKSIAKFFKGVGKVRKGFKEASDLDKNQ | 1295 |
| AP00775 Ref, Oxyopinin 2c (spider) | GKLSGISKVLRAIAKFFKGVGKARKQFKEASDLDKNQ | 1296 |
| AP00776 Ref, Oxyopinin 2d (spider) | GKFSVFSKILRSIAKVFKGVGKVRKGFKTASDLDKNQ | 1297 |
| AP00777 Ref, NRC-1 (XXA, fish, gene predicted) | GKGRWLERIGKAGGIIIGGALDHL | 1298 |
| AP00778 Ref, NRC-2 (XXA, fish, gene predicted) | WLRRIGKGVKIIGGAALDHL | 1299 |
| AP00779 Ref, NRC-3 (XXA, fish, gene predicted) | GRRKRKWLRRIGKGVKIIGGAALDHL | 1300 |
| AP00781 Ref, NRC-5 (XXA, fish, gene predicted) | FLGALIKGAIHGGRFIHGMIQNHH | 1301 |
| AP00782 Ref, NRC-6 (XXA, fish, gene predicted) | GWGSIFKHGRHAAKHIGHAAVNHYL | 1302 |
| AP00783 Ref, NRC-7 (XXA, fish, gene predicted) | RWGKWFKKATHVGKHVGKAALTAYL | 1303 |
| AP00784 Ref, NRC-10 (XXA, fish, gene predicted) | FFRLLFHGVHHVGKIKPRA | 1304 |
| AP00785 Ref, NRC-11 (XXA, fish, gene predicted) | GWKSVFRKAKKVGKTVGGLALDHYL | 1305 |
| AP00786 Ref, NRC-12 (XXA, fish, gene predicted) | GWKKWFNRAKKVGKTVGGLAVDHYL | 1306 |
| AP00787 Ref, NRC-13 (XXA, fish, gene predicted) | GWRLLLKKAEVKTVGKLALKHYL | 1307 |
| AP00788 Ref, NRC-14 (XXA, fish, gene predicted) | AGWGSIFKHIFKAGKFIHGAIQAHND | 1308 |
| AP00789 Ref, NRC-15 (XXA, fish, gene predicted) | GFWGKLFKLGLHGIGLLHLHL | 1309 |
| AP00790 Ref, NRC-16 (XXA, fish, gene predicted) | GWKKWLRKGAKHLGQAAIK | 1310 |
| AP00791 Ref, NRC-17 (XXA, fish, gene predicted) | GWKKWLRKGAKHLGQAAIKGLAS | 1311 |
| AP00792 Ref, NRC-19 (XXA, fish, gene predicted) | FLGLLFHGVHHVGKWIHGLIHGHH | 1312 |
| AP00793 Ref, Bombinin H2 (XXA, frog) | IIGPVLGLVGSALGGLLKKI | 1313 |
| AP00794 Ref, Bombinin H3 (frog, XXD, XXA) | IIGPVLGMVGSALGGLLKKI | 1314 |
| AP00795 Ref, Bombinin H7 (frog, XXD, XXA) | ILGPILGLVSNALGGLL | 1315 |
| AP00796 Ref, Bombinin GH-1L (XXA, toad) | IIGPVLGLVGKPLESLLE | 1316 |
| AP00797 Ref, Bombinin GH-1D (toad, XXD, XXA) | IIGPVLGLVGKPLESLLE | 1317 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00807 Ref, Enterocin E-760 (bacteriocin, bacteria) | NRWYCNSAAGGVGGAAGCVLAGYV GEAKENIAGEVRKGWGMAGGFTHNK ACKSFPGSGWASG | 1318 |
| AP00808 Ref, hepcidin (fish) | CRFCCRCCPRMRGCGLCCRF | 1319 |
| AP00809 Ref, hepcidin TH1-5 (fish) | GIKCRFCCGCCTPGICGVCCRF | 1320 |
| AP00810 Ref, hepcidin TH2-3 (fish) | QSHLSLCRWCCNCCRSNKGC | 1321 |
| AP00811 Ref, human LEAP-2 | MTPFWRGVSLRPIGASCRDDSECITRL CRKRRCSLSVAQE | 1322 |
| AP00812 Ref, Enkelytin (cow) | FAEPLPSEEEGESYSKEPPEMEKRYGG FM | 1323 |
| AP00732 Ref, Spheniscin-1 (Sphe-1, avian defensin) | SFGLCRLRRGSCAHGRCRFPSIPIGRCS RFVQCCRRVW | 1324 |
| AP00733 Ref, Organgutan ppyLL-37 (Great Ape, primate cathelicidin) | LLGDFFRKAREKIGEEFKRIVQRIKDFL RNLVPRTES | 1325 |
| AP00734 Ref, Gibbon hmdSL-37 (hylobatidae, primate cathelicidin) | SLGNFFRKARKKIGEEFKRIVQRIKDF LQHLIPRTEA | 1326 |
| AP00735 Ref, pobRL-37 (cercopithecidae, primate cathelicidin) | RLGNFFRKAKKKIGRGLKKIGQKIKDF LGNLVPRTES | 1327 |
| AP00736 Ref, cjaRL-37 (primate cathelicidin) | RLGDILQKAREKIEGGLKKLVQKIKDF FGKFAPRTES | 1328 |
| AP00737 Ref, Plasticin PBN2KF (XXA, DRP-PBN2, frog) | GLVTSLIKGAGKLLGGLFGSVTG | 1329 |
| AP00738 Ref, Plasticin ANCKF (XXA, synthetic) | GLVTGLLKTAGKLLGDLFGSLTG | 1330 |
| AP00739 Ref, Plasticin PD36KF (XXA, synthetic) | GVVTDLLKTAGKLLGNLFGSLSG | 1331 |
| AP00740 Ref, Plasticin PD36K (XXA, synthetic) | GVVTDLLKTAGKLLGNLVGSLSG | 1332 |
| AP00741 Ref, Chicken cathelicidin-B1 (bird cathelicidin) | PITYLDAILAAVRLLNQRISGPCILRLR EAQPRPGWVGTLQRRREVSFLVEDGP CPPGVDCRSCEPGALQHCVGTVSIEQ QPTAELRCRPLRPQ | 1333 |
| AP00742 Ref, Chicken gallinacin 4 (Gal 4) | MRILYLLLSVLFVVLQGVAGQPYFSSP IHACRYQRGVCIPGPCRWPYYRVGSC GSGLKSCCVRNRWA | 1334 |
| AP00743 Ref, Chicken gallinacin 7 (Gal 7) | MKILCFFIVLFVAVHGAVGFSRSPRYH MQCGYRGTFCTPGKCPYGNAYLGLC RPKYSCCRWL | 1335 |
| AP00744 Ref, Chicken gallinacin 9 (Gal 9) | MQILPLLFAVLLLMLRAEPGLSLARGL PQDCERRGGFCSHKSCPPGIGRIGLCS KEDFCCRSRWYS | 1336 |
| AP00745 Ref, Chicken LEAP-2 (cLEAP-2) | MTPFWRGVSLRPVGASCRDNSECITM LCRKNRCFLRTASE | 1337 |
| AP00814 Ref, Caerulein precursor-related fragment Ea (CPRF-Ea, frog) | GLGSILGKILNVAGKVGKTIGVADA VGNKE | 1338 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00815 Ref, Caerulein precursor-related fragment Eb (CPRF-Eb, frog) | GLGSFLKNAIKIAGKVGSTIGKVADAI GNKE | 1339 |
| AP00816 Ref, Caerulein precursor-related fragment Ec (CPRF-Ec, frog) | GLGSFFKNAIKIAGKVGSTIGKVADAI GNKE | 1340 |
| AP00817 Ref, Temporin-10a (frog) | FLPLLASLFSRLL | 1341 |
| AP00818 Ref, Temporin-10b (frog) | FLPLIGKILGTIL | 1342 |
| AP00819 Ref, Temporin-10c (frog) | FLPLLASLFSRLF | 1343 |
| AP00820 Ref, Temporin-10d (frog) | FLPLLASLFSGLF | 1344 |
| AP00821 Ref, Brevinin-20a (frog) | GLFNVFKGLKTAGKHVAGSLLNQLK CKVSGGC | 1345 |
| AP00822 Ref, Brevinin-20b (frog) | GIFNVFKGALKTAGKHVAGSLLNQLK CKVSGEC | 1346 |
| AP00824 Ref, Temporin-1Gb (XXA, frog) | SILPTIVSFLSKFL | 1347 |
| AP00825 Ref, Temporin-1Gc (XXA, frog) | SILPTIVSFLTKFL | 1348 |
| AP00826 Ref, Temporin-1Gd (XXA, frog) | FILPLIASFLSKFL | 1349 |
| AP00827 Ref, Ranatuerin-1Ga (frog) | SMISVLKNLGKVGLGFVACKVNKQC | 1350 |
| AP00829 Ref, Ranalexin-1G (frog) | FLGGLMKIIPAAFCAVTKKC | 1351 |
| AP00830 Ref, Ranatuerin-2G (frog) | GLLLDTLKGAAKDIAGIALEKLKCKIT GCKP | 1352 |
| AP00831 Ref, Odorranain-NR (frog) | GLLSGILGAGKHIVCGLTGCAKA | 1353 |
| AP00832 Ref, Maximin H1 (XXA, toad) | ILGPVISTIGGVLGGLLKNL | 1354 |
| AP00834 Ref, *G. mellonella* moricin-like peptide A (Gm-mlpA, insect) | KVNANAIKKGGKAIGKGFKVISAAST AHDVYEHIKNRRH | 1355 |
| AP00835 Ref, *G. mellonella* moricin-like peptide B (Gm-mlpB, insect) | GKIPVKAIKKGGQIIGKALRGINIASTA HDIISQFKPKKKKNH | 1356 |
| AP00836 Ref, *G. mellonella* moricin-like peptide C1 (Gm-mlpC1, insect) | KVPIGAIKKGGKIIKKGLGVIGAAGTA HEVYSHVKNRH | 1357 |
| AP00837 Ref, *G. mellonella* moricin-like peptide C2 (Gm-mlpC2, insect) | KVPIGAIKKGGKIIKKGLGVLGAAGTA HEVYNHVRNRQ | 1358 |
| AP00838 Ref, *G. mellonella* moricin-like peptide C3 (Gm-mlpC3, insect) | KVPIGAIKKGGKIIKKGLGVIGAAGTA HEVYSHVKNRQ | 1359 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00839 Ref, *G. mellonella* moricin-like peptide C4/C5 (Gm-mlpC4/C5, insect) | KVPVGAIKKGGKAIKTGLGVVGAAGT AHEVYSHIRNRH | 1360 |
| AP00840 Ref, *G. mellonella* moricin-like peptide D (Gm-mlpD, insect) | KGIGSALKKGGKIIKGGLGALGAIGTG QQVYEHVQNRQ | 1361 |
| AP00841 Ref, Enterocin A (EntA, class IIA bacteriocin, i.e. pediocin-like peptide, bacteria) | TTHSGKYYGNGVYCTKNKCTVDWAK ATTCIAGMSIGGFLGGAIPGKC | 1362 |
| AP00842 Ref, Divercin V41 (DvnV41, class IIa bacteriocin, pediocin-like peptide, bacteria. DvnRV41 is the recombinant form) | TKYYGNGVYCNSKKCWVDWGQASG CIGQTVVGGWLGGAIPGKC | 1363 |
| AP00843 Ref, Divergicin M35 (class IIa bacteriocin, pediocin-like peptide, bacteria) | TKYYGNGVYCNSKKCWVDWGTAQG CIDVVIGQLGGGIPGKGKC | 1364 |
| AP00844 Ref, Coagulin (bacteriocin, pediocin-like peptide, bacteria) | KYYGNGVTCGKHSCSVDWGKATTCII NNGAMAWATGGHQGTHKC | 1365 |
| AP00845 Ref, Listeriocin 743A (class IIa bacteriocin, pediocin-like peptide, bacteria) | KSYGNGVHCNKKKCWVDWGSAISTI GNNSAANWATGGAAGWKS | 1366 |
| AP00846 Ref, Mundticin KS (enterocin CRL35, mundticin AT06, mundticin QU2, class IIa bacteriocin, pediocin-like peptide, bacteria) | KYYGNGVSCNKKGCSVDWGKAIGIIG NNSAANLATGGAAGWKS | 1367 |
| AP00847 Ref, Sakacin 5X (Sak5X, class IIa bacteriocin, pediocin-like peptide, bacteria) | KYYGNGLSCNKSGCSVDWSKAISIIGN NAVANLTTGGAAGWKS | 1368 |
| AP00848 Ref, Leucocin C (class IIa bacteriocin, pediocin-like peptide, bacteria) | KNYGNGVHCTKKGCSVDWGYAWAN IANNSVMNGLTGGNAGWHN | 1369 |
| AP00849 Ref, Lactococcin MMFII (class IIa bacteriocin, pediocin-like peptide, bacteria) | TSYGNGVHCNKSKCWIDVSELETYKA GTVSNPKDILW | 1370 |
| AP00850 Ref, Sakacin G (SakG, class IIa bacteriocin, pediocin-like peptide, bacteria) | KYYGNGVSCNSHGCSVNWGQAWTC GVNHLANGGHGVC | 1371 |
| AP00851 Ref, Plantaricin 423 (class IIa bacteriocin, pediocin-like peptide, bacteria) | KYYGNGVTCGKHSCSVNWGQAFSCS VSHLANFGHGKC | 1372 |
| AP00852 Ref, Plantaricin C19 (class IIa bacteriocin, pediocin-like peptide, bacteria) | KYYGNGLSCSKKGCTVNWGQAFSCG VNRVATAGHHKC | 1373 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00853 Ref, Enterocin P (EntP, class IIa bacteriocin, pediocin-like peptide, bacteria) | ATRSYGNGVYCNNSKCWVNWGEAK ENIAGIVISGWASGLAGMGH | 1374 |
| AP00854 Ref, Bacteriocin 31 (Bac 31, Bac31, class IIa bacteriocin, pediocin-like peptide, bacteria) | ATYYGNGLYCNKQKCWVDWNKASR EIGKIIVNGWVQHGPWAPR | 1375 |
| AP00855 Ref, MSI-78 (XXA, synthetic) | GIGKFLKKAKKFGKAFVKILKK | 1376 |
| AP00856 Ref, MSI-594 (XXA, synthetic) | GIGKFLKKAKKGIGAVLKVLTTGL | 1377 |
| AP00857 Ref, Catestatin (human CHGA(352-372), human Cst) | SSMKLSFRARAYGFRGPGPQL | 1378 |
| AP00858 Ref, Temporin D (XXA, frog) | LLPIVGNLLNSLL | 1379 |
| AP00859 Ref, Temporin H (XXA, frog) | LSPNLLKSLL | 1380 |
| AP00861 Ref, Brevinin-ALb (frog) | FLPLAVSLAANFLPKLFCKITKKC | 1381 |
| AP00862 Ref, Brevinin 1E (frog) | FLPLLAGLAANFLPKIFCKITKRC | 1382 |
| AP00863 Ref, Temporin-ALa (XXA, frog) | FLPIVGKLLSGLSGLL | 1383 |
| AP00864 Ref, Temporin 1ARa (XXA, frog) | FLPIVGRLISGLL | 1384 |
| AP00865 Ref, Temporin 1AUa (XXA, Temporin-1AUa) (frog) | FLPIIGQLLSGLL | 1385 |
| AP00866 Ref, Temporin 1Bya (XXA, Temporin-1Bya, frog) | FLPIIAKVLSGLL | 1386 |
| AP00867 Ref, Temporin 1Ec (XXA, frog) | FLPVIAGLLSKLF | 1387 |
| AP00869 Ref, Temporin 1Ja (XXA, Temporin-1Ja, frog) | ILPLVGNLLNDLL | 1388 |
| AP00873 Ref, Temporin 1Pra (XXA, frog) | ILPILGNLLNGLL | 1389 |
| AP00874 Ref, Temporin 1VE (XXA, frog) | FLPLVGKILSGLI | 1390 |
| AP00875 Ref, Temporin 1Va (XXA, frog) | FLSSIGKILGNLL | 1391 |
| AP00876 Ref, Temporin 1Vb (XXA, frog) | FLSIIAKVLGSLF | 1392 |
| AP00877 Ref, Brevinin-1Ja (frog) | FLGSLIGAAIPAIKQLLGLKK | 1393 |
| AP00878 Ref, Brevinin-1BYa (frog) | FLPILASLAAKFGPKLFCLVTKKC | 1394 |
| AP00884 Ref, Ixosin-B (tick) | QLKVDLWGTRSGIQPEQHSSGKSDVR RWRSRY | 1395 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00885 Ref, Brevinin-1BYb (frog) | FLPILASLAAKLGPKLFCLVTKKC | 1396 |
| AP00886 Ref, Brevinin-1BYc (frog) | FLPILASLAATLGPKLLCLITKKC | 1397 |
| AP00887 Ref, Brevinin-2BYa (frog) | GILSTFKGLAKGVAKDLAGNLLDKFK CKITGC | 1398 |
| AP00888 Ref, Brevinin-2BYb (frog) | GIMDSVKGLAKNLAGKLLDSLKCKIT GC | 1399 |
| AP00891 Ref, Pilosulin 3 (Myr b III) (ants) | IIGLVSKGTCVLVKTVCKKVLKQG | 1400 |
| AP00892 Ref, Pilosulin 4 (Myr b IV) (ants) | PDITKLNIKKLTKATCKVISKGASMCK VLFDKKKQE | 1401 |
| AP00893 Ref, Pilosulin 5 (Myr b III) (ants) | DVKGMKKAIKGILDCVIEKGYDKLAA KLKKVIQQLWE | 1402 |
| AP00894 Ref, Ocellatin 4 (XXA, frog) | GLLDFVTGVGKDIFAQLIKQI | 1403 |
| AP00895 Ref, OH-CATH (snake cathelicidin, reptile cathelicidin, or elapid cathelicidins) | KRFKKFFKKLKNSVKKRAKKFFKKPR VIGVSIPF | 1404 |
| AP00896 Ref, BF-CATH (snake cathelicidin) | KRFKKFFKKLKKSVKKRAKKFFKKPR VIGVSIPF | 1405 |
| AP00897 Ref, NA-CATH (snake cathelicidin) | KRFKKFFKKLKNSVKKRAKKFFKKPK VIGVTFPF | 1406 |
| AP00898 Ref, Temporin-1Sa (XXA, frog) | FLSGIVGMLGKLF | 1407 |
| AP00899 Ref, Temporin-1Sb (XXA, frog) | FLPIVTNLLSGLL | 1408 |
| AP00900 Ref, Temporin-1Sc (XXA, frog) | FLSHIAGFLSNLF | 1409 |
| AP00913 Ref, Ib-AMP1 (IbAMP1, plant defensin) | EWGRRCCGWGPGRRYCVRWC | 1410 |
| AP00914 Ref, Ib-AMP2 (IBAMP2, plant defensin) | QYGRRCCNWGPGRRYCKRWC | 1411 |
| AP00915 Ref, Ee-CBP (EeCBP, plant defensin, hevein-type, *E. europaeus* chitin-binding protein) | QQCGRQAGNRRCANNLCCSQYGYCG RTNEYCCTSQGCQSQCRRCG | 1412 |
| AP00916 Ref, Pa-AMP1 (PaAMP1, plant defensin, C6 type) | AGCIKNGGRCNASAGPPYCCSSYCFQI AGQSYGVCKNR | 1413 |
| AP00917 Ref, Pa-AMP2 (PaAMP2, plant defensin, C6 type) | ACIKNGGRCVASGGPPYCCSNYCLQI AGQSYGVCKKH | 1414 |
| AP00924 Ref, Ornithodoros defensin B (soft ticks) | GYGCPFNQYQCHSHCRGIRGYKGGY CTGRFKQTCKCY | 1415 |
| AP00925 Ref, Ornithodoros defensin C (soft ticks) | GYGCPFNQYQCHSHCSGIRGYKGGYC KGLFKQTCNCY | 1416 |
| AP00926 Ref, Ornithodoros defensin D (soft ticks) | GFGCPFNQYECHAHCSGVPGYKGGY CKGLFKQTCNCY | 1417 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP00927 Ref, Butyrivibriocin AR10 (XXC, class IV bacteriocin, gram-positive bacteria) | IYFIADKMGIQLAPAWYQDIVNWVSA GGTLTTGFAIIVGVTVPAWIAEAAAAF GIASA | 1418 |
| AP00929 Ref, AS-48 (enterocin 4, XXC, class IV bacteriocin or class IId bacteriocin, Gram-positive bacteria) | ASLQFLPIAHMAKEFGIPAAVAGTVIN VVEAGGWVTTIVSILTAVGSGGLSLLA AAGRESIKAYLKKEIKKKGKRAVIAW | 1419 |
| AP00930 Ref, Reutericin 6 (XXC, XXD1, class IV bacteriocin, Gram-positive bacteria) | IYWIADQFGIHLATGTARKLLDAMAS GASLGTAFAAILGVTLPAWALAAAGA LGATAA | 1420 |
| AP00931 Ref, Uberolysin (XXC, class IV bacteriocin, Gram-positive bacteria) | LAGYTGIASGTAKKVVDAIDKGAAAF VIISIISTVISAGALGAVSASADFIILTVK NYISRNLKAQAVIW | 1421 |
| AP00932 Ref, Acidocin B (XXC, class IV bacteriocin, Gram-positive bacteria) | IYWIADQFGIHLATGTARKLLDAVAS GASLGTAFAAILGVTLPAWALAAAGA LGATAA | 1422 |
| AP00980 Ref, Phormia defensin B (insect defensin B) | ATCDLLSGTGINHSACAAHCLLRGNR GGYCNRKGVCVCRN | 1423 |
| AP00990 Ref, Pth-St1 (plant defensin) | RNCESLSHRFKGPCTRDSN | 1424 |
| AP00991 Ref, Snakin-1 (StSN1, plant defensin) | GSNFCDSKCKLRCSKAGLADRCLKYC GICCEECKCVPSGTYGNKHECPCYRD KKNSKGKSKCP | 1425 |
| AP00992 Ref, Snakin-2 (StSN2, plant defensin) | YSYKKIDCGGACAARCRLSSRPRLCN RACGTCCARCNCVPPGTSGNTETCPC YASLTTHGNKRKCP | 1426 |
| AP00993 Ref, So-D2 (S. oleracea defensin D2, plant defensin) | GIFSSRKCKTPSKTFKGICTRDSNCDTS CRYEGYPAGDCKGIRRRCMCSKPC | 1427 |
| AP00994 Ref, So-D6 (S. oleracea defensin D6, plant defensin) | GIFSNMYARTPAGYFRGP | 1428 |
| AP00997 Ref, Nisin Q (lantibiotic, bacteriocins, bacteria) | ITSISLCTPGCKTGVLMGCNLKTATCN CSVHVSK | 1429 |
| AP01008 Ref, Tachystatin A1 (BBS, horseshoe crabs) | YSRCQLQGFNCVVRSYGLPTIPCCRGL TCRSYFPGSTYGRCQRF | 1430 |
| AP01009 Ref, Tachystatin C (BBS, horseshoe crabs) | DYDWSLRGPPKCATYGQKCRTWSPR NCCWNLRCKAFRCRPR | 1431 |
| AP01012 Ref, Latarcin 3a (Ltc3a, XXA, BBM, spider) | SWKSMAKKLKEYMEKLKQRA | 1432 |
| AP01013 Ref, Latarcin 3b (Ltc3b, XXA, BBM, spider) | SWASMAKKLKEYMEKLKQRA | 1433 |
| AP01014 Ref, Latarcin 4a (Ltc4a, XXA, BBM, spider) | GLKDKFKSMGEKLKQYIQTWKAKF | 1434 |
| AP01015 Ref, Latarcin 4b (Ltc4b, XXA, BBM, spider) | SLKDKVKSMGEKLKQYIQTWKAKF | 1435 |
| AP01016 Ref, Latarcin 5 (Ltc5, XXA, BBM, spider) | GFFGKMKEYFKKFGASFKRRFANLKK RL | 1436 |
| AP01018 Ref, Latarcin 6a (Ltc6a, BBM, spider) | QAFQTFKPDWNKIRYDAMKMQTSLG QMKKRFNL | 1437 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP01019 Ref, Latarcin 7 (Ltc7, BBM, spider) | GETFDKLKEKLKTFYQKLVEKAEDLK GDLKAKLS | 1438 |
| AP01049 Ref, Kalata B2 (plant cyclotides, XXC) | VCGETCFGGTCNTPGCSCTWPICTRD GLP | 1439 |
| AP01141 Ref, Cryptdin-6 (Crp6, animal defensin, alpha, mouse) | LRDLVCYCRARGCKGRERMNGTCRK GHLLYMLCCR | 1440 |
| AP01142 Ref, Rabbit kidney defensin RK-2 (animal defensin, alpha-defensin) | KPYCSCKWRCGIGEEEKGICHKFPIVT YVCCRRP | 1441 |
| AP01146 Ref, Gallinacin 6 (Gal6, Gal-6, avian beta defensin, bird) | DTLACRQSHGSCSFVACRAPSVDIGTC RGGKLKCCKWAPSS | 1442 |
| AP01147 Ref, Gallinacin 8 (Gal8, Gal-8, avian beta defensin, bird) | DTVACRIQGNFCRAGACPPTFTISGQC HGGLLNCCAKIPAQ | 1443 |
| AP01148 Ref, Gallinacin 3 (Gal3, Gal-3, avian beta defensin, bird) | IATQCRIRGGFCRVGSCRFPHIAIGKCA TFISCCGRAY | 1444 |
| AP01152 Ref, Lactococcin Q (class IIb bacteriocin, bacteria, chain a. For chain b, see Info) | SIWGDIGQGVGKAAYWVGKAMGNM SDVNQASRINRKKKH | 1445 |
| AP01155 Ref, Enterocin 1071 (Ent1071A, class IIb bacteriocin, bacteria; chain B is Enterocin 1071B or Ent1071B, see info) | ESVFSKIGNAVGPAAYWILKGLGNMS DVNQADRINRKKH | 1446 |
| AP01156 Ref, Plantaricin S (chain a, class IIb bacteriocin, bacteria) | NKLAYNMGHYAGKATIFGLAAWALLA | 1447 |
| AP01159 Ref, Hinnavin II (Hin II, XXA, insect) | KWKIFKKIEHMGQNIRDGLIKAGPAV QVVGQAATIYK | 1448 |
| AP01160 Ref, NK-2 (synthetic, XXA) | KILRGLCKKIMRSFLRRISWDILTGKK | 1449 |
| AP01167 Ref, Plantaricin NC8 (PLNC8, chain a, class IIb bacteriocin, bacteria. For chain b, see Info) | LTTKLWSSWGYYLGKKARWNLKHPY VQF | 1450 |
| AP01168 Ref, Carnocyclin A (a circular bacteriocin, XXC, bacteria) | LVAYGIAQGTAEKVVSLINAGLTVGSI ISILGGVTVGLSGVFTAVKAAIAKQGI KKAIQL | 1451 |
| AP01169 Ref, Lactacin F (LafX, class IIb bacteriocin, bacteria. For LafA, see Info) | NRWGDTVLSAASGAGTGIKACKSFGP WGMAICGVGGAAIGGYFGYTHN | 1452 |
| AP01170 Ref, Brochocin C (BrcC, chain BrcA, class IIb bacteriocin, bacteria. For BrcB, see Info) | YSSKDCLKDIGKGIGAGTVAGAAGGG LAAGLGAIPGAFVGAHFGVIGGSAACI GGLLGN | 1453 |
| AP01171 Ref, Thermophilin 13 (chain a ThmA, 2-chain | YSGKDCLKDMGGYALAGAGSGALW GAPAGGVGALPGAFVGAHVGAIAGG | 1454 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| class IIb bacteriocin, bacteria. For chain B ThmB, see Info) | FACMGGMIGNKFN | |
| AP01172 Ref, ABP-118 (chain a: Abp118alpha, class IIb bacteriocin, bacteria. For chain b: Abp118beta, see Info) | KRGPNCVGNFLGGLFAGAAAGVPLGP AGIVGGANLGMVGGALTCL | 1455 |
| AP01173 Ref, Salivaricin P (chain a: Sln1; class IIb bacteriocin, bacteria. For chain b: Sln2, see Info) | KRGPNCVGNFLGGLFAGAAAGVPLGP AGIVGGANLGMVGGALTCL | 1456 |
| AP01174 Ref, Mutacin IV (chain a: NlmA, class IIb bacteriocin, bacteria. For chain b: NLmB, see Info) | KVSGGEAVAAIGICATASAAIGGLAG ATLVTPYCVGTWGLIRSH | 1457 |
| AP01175 Ref, Lactocin 705 (chain a: Lac705alpha; class IIb bacteriocin, bacteria. For chain b: Lac705beta, see Info) | GMSGYIQGIPDFLKGYLHGISAANKH KKGRLGY | 1458 |
| AP01176 Ref, Cytolysin (CylLS, bacteria; Chain B: CylLL) | TTPACFTIGLGVGALFSAKFC | 1459 |
| AP01177 Ref, Plantaricin EF (chain a: PlnE, class IIb bacteriocin, bacteria. Chain b: PlnF) | FNRGGYNFGKSVRHVVDAIGSVAGIL KSIR | 1460 |
| AP01178 Ref, Plantaricin JK (chain a: PlnJ; class IIb bacteriocin, bacteria. Chain b: PlnK) | GAWKNFWSSLRKGFYDGEAGRAIRR | 1461 |
| AP01179 Ref, Enterocin SE-K4 (class IIa bacteriocin, bacteria) | NGVYCNKQKCWVDWSRARSEIIDRG VKAYVNGFTKVLGGIGGR | 1462 |
| AP01180 Ref, Acidocin J1132 (class IIb bacteriocin, bacteria) | NPKVAHCASQIGRSTAWGAVSGA | 1463 |
| AP01181 Ref, Curvaticin L442 (class IIa bacteriocin, bacteria) | AYPGNGVHCGKYSCTVDKQTAIGNIG NNAA | 1464 |
| AP01182 Ref, Bacteriocin 32 (Bac 32, class IIa bacteriocin, bacteria) | FTPSVSFSQNGGVVEAAAQRGYIYKK YPKGAKVPNKVKMLVNIRGKQTMRT CYLMSWTASSRTAKYYYYI | 1465 |
| AP01183 Ref, Bacteriocin 43 (Bac 43, bacteriocin, bacteria) | ATYYGNGLYCNKEKCWVDWNQAKG EIGKIIVNGWVNHGPWAPRR | 1466 |
| AP01184 Ref, Bacteriocin T8 (Bac T8, class IIa bacteriocin, bacteria) | ATYYGNGLYCNKEKCWVDWNQAKG EIGKIIVNGWVNHGPWAPRR | 1467 |
| AP01185 Ref, Enterocin B (EntB, bacteriocin, bacteria) | ENDHRMPNNLNRPNNLSKGGAKCGA AIAGGLFGIPKGPLAWAAGLANVYSK CN | 1468 |
| AP01186 Ref, Acidocin A (bacteriocin, bacteria) | KTYYGTNGVHCTKKSLWGKVRLKNV IPGTLCRKQSLPIKQDLKILLGWATGA FGKTFH | 1469 |

TABLE 10-continued

Other illustrative antimicrobial peptides. AP numbers refer to ID in antimicrobial peptide database (aps.unmc.edu/AP/main.php).

| | Effector | Structure/Sequence | SEQ ID No |
|---|---|---|---|
| AP01187 | Ref, Enterocin Q (EntQ, class IIc bacteriocin, leaderless, i.e. no signal peptide, bacteria) | MNFLKNGIAKWMTGAELQAYKKKY GCLPWEKISC | 1470 |
| AP01188 | Ref, Enterocin EJ97 (EntEJ97, class IIc bacteriocin, leaderless, i.e. no signal peptide, bacteria) | MLAKIKAMIKKFPNPYTLAAKLTTYEI NWYKQQYGRYPWERPVA | 1471 |
| AP01189 | Ref, Enterocin RJ-11 (EntRJ-11, class IIc bacteriocin, leaderless, i.e. no signal sequence, bacteria) | APAGLVAKFGRPIVKKYYKQIMQFIG EGSAINKIIPWIARMWRT | 1472 |
| AP01190 | Ref, Enterocin L50 (old name: pediocin L50, EntL50A, a two-chain class IIc bacteriocin, leaderless, i.e. no signal peptide, bacteria. The sequence of EntL50B is provided in Info) | MGAIAKLVAKFGWPIVKKYYKQIMQ FIGEGWAINKIIEWIKKHI | 1473 |
| AP01191 | Ref, MR10 (MR10A, class IIc bacteriocin, leaderless, i.e. no signal peptide, bacteria. For the sequence of chain b, see Info) | MGAIAKLVAKFGWPIVKKYYKQIMQ FIGEGWAINKIIDWIKKHI | 1474 |
| AP01192 | Ref, Halocin S8 (HalS8, microhalocin, archaeocins, archeae) | SDCNINSNTAADVILCFNQVGSCALCS PTLVGGPVP | 1475 |
| AP01193 | Ref, Halocin C8 (HalC8, microhalocins, archaeocins, archaea) | DIDITGCSACKYAAGQVCTIGCSAAG GFICGLLGITIPVAGLSCLGFVEIVCTV ADEYSGCGDAVAKEACNRAGLC | 1476 |
| AP01194 | Ref, Lacticin 3147 (chain A1, a two-chain lantibiotic, bacteriocin, bacteria. The sequence of chain A2 is given in Info; XXD3) | CSTNTFSLSDYWGNNGAWCTLTHEC MAWCK | 1477 |
| AP01195 | Ref, Salivaricin A (SalA, lantibiotic, bacteriocin, bacteria) | KRGSGWIATITDDCPNSVFVCC | 1478 |
| AP01196 | Ref, Microcin E492 (McCE492, class IIb microcins, bacteriocin, bacteria; BBM; u-McCE492, siderophore peptide, BBI, XXG) | ATYYGNGLYCNKEKCWVDWNQAKG EIGKIIVNGWVNHGPWAPRR | 1479 |
| AP01197 | Ref, Hiracin JM79 (HirJM79, a Sec-dependent class II bacteriocin, bacteria) | ATYYGNGLYCNKEKCWVDWNQAKG EIGKIIVNGWVNHGPWAPRR | 1480 |
| AP01198 | Ref, Thermophilin 9 (BlpDst, class IIb bacteriocin, bacteria. beta-chains: BlpUst, BlpEst, BapFst) | LSCDEGMLAVGGLGAVGGPWGAAV GVLVGAALYCF | 1481 |
| AP01199 | Ref, Penocin A (PenA, class IIa bacteriocin, bacteria) | KYYGNGVHCGKKTCYVDWGQATASI GKIIVNGWTQHGPWAHR | 1482 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP01200 Ref, Salivaricin B (SalB, lantibotic, bacteriocin, bacteria) | GGGVIQTISHECRMNSWQFLFTCCS | 1483 |
| AP01201 Ref, Lacticin 481 (lantibiotic, class I bacteriocin, bacteria) | KGGSGVIHTISHECNMNSWQFVFTCCS | 1484 |
| AP01202 Ref, Bacteriocin J46 (BacJ46, bacteriocin, bacteria) | KGGSGVIHTISHEVIYNSWNFVFTCCS | 1485 |
| AP01203 Ref, Nukacin A (NucA, Nukacin ISK-1, NukISK-1, bacteriocin, bacteria) | KKKSGVIPTVSHDCHMNSFQFVFTCCS | 1486 |
| AP01204 Ref, Streptococcin A-FF22 (LANTIBIOTIC, class I bacteriocin, bacteria) | GKNGVFKTISHECHLNTWAFLATCCS | 1487 |
| AP01210 Ref, Jelleine-I (honeybees, insect, XXA) | PFKLSLHL | 1488 |
| AP01211 Ref, Jelleine-II (honeybees, insect, XXA) | TPFKLSLHL | 1489 |
| AP01212 Ref, Jelleine-III (honeybees, insect, XXA) | EPFKLSLHL | 1490 |
| AP01213 Ref, Hymenoptaecin (honeybees, insect defensin, XXcooh) | EFRGSIVIQGTKEGKSRPSLDIDYKQR VYDKNGMTGDAYGGLNIRPGQPSRQ HAGFEFGKEYKNGFIKGQSEVQRGPG GRLSPYFGINGGFRF | 1491 |
| AP01216 Ref, Ascaphin-1 (frog, XXA) | GFRDVLKGAAKAFVKTVAGHIAN | 1492 |
| AP01218 Ref, Ascaphin-3 (frog) | GFRDVLKGAAKAFVKTVAGHIANI | 1493 |
| AP01220 Ref, Ascaphin-5 (frog) | GIKDWIKGAAKKLIKTVASNIANQ | 1494 |
| AP01222 Ref, Ascaphin-7 (frog) | GFKDWIKGAAKKLIKTVASSIANQ | 1495 |
| AP01223 Ref, Ascaphin-8 (frog, XXA) | GFKDLLKGAAKALVKTVLF | 1496 |
| AP01226 Ref, Microcin C7 (MccC7, microcin C51, MccC51, class I microcins, bacteriocins, bacteria. Others: MccA; XXamp; BBPe) | MRTGNAD | 1497 |
| AP01227 Ref, Microcin B17 (MccB17, class I microcins, bacteriocins, Gram-negative bacteria; BBPe) | VGIGGGGGGGGGSCGGQGGGCGGC SNGCSGGNGGSGGSGSHI | 1498 |
| AP01228 Ref, Microcin V (MccV, (old name) Colicin V, ColV; class II microcins, bacteriocins, Gram-negative bacteria) | ASGRDIAMAIGTLSGQFVAGGIGAAA GGVAGGAIYDYASTHKPNPAMSPSGL GGTIKQKPEGIPSEAWNYAAGRLCNW SPNNLSDVCL | 1499 |
| AP01229 Ref, Microcin L (MccL, class IIa microcins, bacteriocins, Gram-negative bacteria) | GDVNWVDVGKTVATNGAGVIGGAFG AGLCGPVCAGAFAVGSSAAVAALYD AAGNSNSAKQKPEGLPPEAWNYAEG RMCNWSPNNLSDVCL | 1500 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| AP01230 Ref, Microcin M (MccM, class IIb microcins, bacteriocins, Gram-negative bacteria) | DGNDGQAELIAIGSLAGTFISPGFGSIA GAYIGDKVHSWATTATVSPSMSPSGI GLSSQFGSGRGTSSASSSAGSGS | 1501 |
| AP01231 Ref, Microcin H47 (MccH47, class IIb microcins, bacteriocins, Gram-negative bacteria) | GGAPATSANAAGAAAIVGALAGIPGG PLGVVVGAVSAGLTTGIGSTVGSGSA SSSAGGGS | 1502 |
| AP01232 Ref, Microcin I47 (MccI47, class IIb microcins, bacteriocins, Gram-negative bacteria) | MNLNGLPASTNVIDLRGKDMGTYIDA NGACWAPDTPSIIMYPGGSGPSYSMSS STSSANSGS | 1503 |
| Aibellin | *Ac U A U A U A Q U F U G U U P V U U E E [NHC(CH2Ph)HCH2NHCH2CH2]OH | 1504 |
| Alamethicin_F-30 | *Ac U P U A U A Q U V U G L U P V U U E Q F OH | 1505 |
| Alamethicin_F-50 | *Ac U P U A U A Q U V U G L U P V U U Q Q F OH | 1506 |
| Alamethicin_II | *Ac U P U A U U Q U V U G L U P V U U E Q F OH | 1507 |
| Ampullosporin | *Ac W A U U L U Q U U U Q L U Q L OH | 1508 |
| Ampullosporin_B | *Ac W A U U L U Q A U U Q L U Q L OH | 1509 |
| Ampullosporin_C | *Ac W A U U L U Q U A U Q L U Q L OH | 1510 |
| Ampullosporin_D | *Ac W A U U L U Q U U A Q L U Q L OH | 1511 |
| Ampullosporin_E1 | *Ac W A U U L U Q A U U Q L A Q L OH | 1512 |
| Ampullosporin_E2 | *Ac W A U U L U Q U A A Q L U Q L OH | 1513 |
| Ampullosporin_E3 | *Ac W A U U L U Q U U A Q L A Q L OH | 1514 |
| Ampullosporin_E4 | *Ac W A U U L U Q A A U Q L U Q L OH | 1515 |
| Antiamoebin_I | *Ac F U U U J G L U U O Q J O U P F OH | 1516 |
| Antiamoebin_II | *Ac F U U U J G L U U O Q J P U P F OH | 1517 |
| Antiamoebin_III | *Ac F U U U U G L U U O Q J O U P F OH | 1518 |
| Antiamoebin_IV | *Ac F U U U J G L U U O Q J O U P F OH | 1519 |
| Antiamoebin_V | *Ac F U U U J A L U U O Q J O U P F OH | 1520 |
| Antiamoebin_VI | *Ac F U U U U G L U U O Q U O U P F OH | 1521 |
| Antiamoebin_VII | *Ac F A U J U G L U U O Q J O U P F OH | 1522 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Antiamoebin_VIII | *Ac F U U U J G L U U O Q U O U P F OH | 1523 |
| Antiamoebin_IX | *Ac F U A U J G L U U O Q J O U P F OH | 1524 |
| Antiamoebin_X | *Ac F U U U J G L J U O Q U O U P F OH | 1525 |
| Antiamoebin_XI | *Ac F U U U A L U U O Q J O U P F OH | 1526 |
| Antiamoebin_XII | *Ac F U U U U G L A U O Q J O U P F OH | 1527 |
| Antiamoebin_XIII | *Ac V U U U U G L U U O Q J O U P F OH | 1528 |
| Antiamoebin_XIV | *Ac V U U U V G L U U O Q J O U P F OH | 1529 |
| Antiamoebin_XV | *Ac L U U U U G L U U O Q J O U P F OH | 1530 |
| Antiamoebin_XVI | *Ac L U U U J G L U U O Q J O U P F OH | 1531 |
| Atroviridin_A | *Ac U P U A U A Q U V U G L U P V U U Q Q F OH | 1532 |
| Atroviridin_B | *Ac U P U A U A Q U V U G L U P V U J Q Q F OH | 1533 |
| Atroviridin_C | *Ac U P U A U U Q U V U G L U P V U J Q Q F OH | 1534 |
| Bergofungin_A | *Ac V U U U V G L U U O Q J O U F OH | 1535 |
| Bergofungin_B | *Ac V U U U V G L V U O Q U O U F OH | 1536 |
| Bergofungin_C | *Ac V U U U V G L U U O Q U O U F OH | 1537 |
| Bergofungin_D | *Ac V U U V G L U U O Q U O U F OH | 1538 |
| Boletusin | *Ac F U A U J L Q G U U A A U P U U U Q W OH | 1539 |
| Cephaibol_A | *Ac F U U U U G L J U O Q J O U P F OH | 1540 |
| Cephaibol_A2 | *Ac F U U U A L J U O Q J O U P F OH | 1541 |
| Cephaibol_B | *Ac F U U U J G L J U O Q J O U P F OH | 1542 |
| Cephaibol_C | *Ac F U U U U G L J U O Q U O U P F OH | 1543 |
| Cephaibol_D | *Ac F U U U U G L U U O Q U O U P F OH | 1544 |
| Cephaibol_E | *Ac F U U U U G L U U O Q J O U P F OH | 1545 |
| Cephaibol_P | *Ac F J Q U I T U L U O Q U O U P F S OH | 1546 |
| Cephaibol_Q | *Ac F J Q U I T U L U P Q U O U P F S OH | 1547 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Cervinin_1 | *Ac L U P U L U P A U P V L OH | 1548 |
| Cervinin_2 | *Ac L U P U L U P A U P V L OCOCH3 | 1549 |
| Chrysospermin_A | *Ac F U S U U L Q G U U A A U P U U U Q W OH | 1550 |
| Chrysospermin_B | *Ac F U S U U L Q G U U A A U P J U U Q W OH | 1551 |
| Chrysospermin_C | *Ac F U S U J L Q G U U A A U P U U U Q W OH | 1552 |
| Chrysospermin_D | *Ac F U S U J L Q G U U A A U P J U U Q W OH | 1553 |
| Clonostachin | *Ac U O L J O L J O U J U O J I O[CH(CH(OH)CH2OH)CH(OH)CH(OH)CH2]OH | 1554 |
| Emerimicin_II_A | *Ac W I Q U I T U L U O Q U O U P F OH | 1555 |
| Emerimicin_II_B | *Ac W I Q J I T U L U O Q U O U P F OH | 1556 |
| Emerimicin_III | *Ac F U U U V G L U U O Q J O U F OH | 1557 |
| Emerimicin_IV | *Ac F U U U V G L U U O Q J O A F OH | 1558 |
| Harzianin_HB_I | *Ac U N L I U P J L U P L OH | 1559 |
| Harzianin_HC_I | *Ac U N L U P S V U P U L U P L OH | 1560 |
| Harzianin_HC_III | *Ac U N L U P S V U P J L U P L OH | 1561 |
| Harzianin_HC_IX | *Ac U N L U P A I U P J L U P L OH | 1562 |
| Harzianin_HC_VI | *Ac U N L U P A V U P U L U P L OH | 1563 |
| Harzianin_HC_VIII | *Ac U N L U P A V U P J L U P L OH | 1564 |
| Harzianin_HC_VIII | *Ac U N L U P A V U P J L U P L OH | 1565 |
| Harzianin_HC_X | *Ac U Q L U P A V U P J L U P L OH | 1566 |
| Harzianin_HC_XI | *Ac U N L U P S I U P U L U P L OH | 1567 |
| Harzianin_HC_XII | *Ac U N L U P S I U P J L U P L OH | 1568 |
| Harzianin_HC_XIII | *Ac U Q L U P S I U P J L U P L OH | 1569 |
| Harzianin_HC_XIV | *Ac U N L U P A I U P U L U P L OH | 1570 |
| Harzianin_HC_XV | *Ac U Q L U P A I U P J L U P L OH | 1571 |
| Harzianin_HK_VI | *Ac U N I I U P L L U P L OH | 1572 |
| Harzianin_PCU4 | *Ac U N L U P S I U P U L U P V OH | 1573 |
| Helioferin_A | *Fa P ZZ A U I I U U AAE | 1574 |
| Helioferin_B | *Fa P ZZ A U I I U U AMAE | 1575 |
| Heptaibin | *Ac F U U U V G L U U O Q U O U F OH | 1576 |
| Hypelcin_A | *Ac U P U A U U Q L U G U U U P V U U Q Q L OH | 1577 |
| Hypelcin_A_I | *Ac U P U A U U Q U L U G U U U P V U U Q Q L OH | 1578 |
| Hypelcin_A_II | *Ac U P U A U A Q U L U G U U P V U U Q Q L OH | 1579 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Hypelcin_A_III | *Ac U P U A U U Q U L U G U U P V U U Q Q [C7H16NO] | 1580 |
| Hypelcin_A_IV | *Ac U P U A U U Q U I U G U U P V U U Q Q L OH | 1581 |
| Hypelcin_A-III | *Ac U P U A U U Q U L U G U U P V U J Q Q L OH | 1582 |
| Hypelcin_A-IX | *Ac U P U A U U Q U I U G U U P V U J Q Q L OH | 1583 |
| Hypelcin_A-V | *Ac U P U A U U Q U L U G U U P V U U Q Q I OH | 1584 |
| Hypelcin_A-VI | *Ac U P U A U A Q U L U G U U P V U U Q Q I OH | 1585 |
| Hypelcin_A-VII | *Ac U P U A U A Q U L U G U U P V U J Q Q L OH | 1586 |
| Hypelcin_A-VIII | *Ac U P U A U A Q U I U G U U P V U U Q Q L OH | 1587 |
| Hypelcin_B_I | *Ac U P U A U U Q U L U G U U P V U U E Q L OH | 1588 |
| Hypelcin_B_II | *Ac U P U A U A Q U L U G U U P V U U E Q L OH | 1589 |
| Hypelcin_B_III | *Ac U P U A U U Q U L U G U U P V U J E Q L OH | 1590 |
| Hypelcin_B_IV | *Ac U P U A U U Q U I U G U U P V U U E Q L OH | 1591 |
| Hypelcin_B_V | *Ac U P U A U U Q U L U G U U P V U U E Q I OH | 1592 |
| Hypomurocin_A_I | *Ac U Q V V U P L L U P L OH | 1593 |
| Hypomurocin_A_II | *Ac J Q V V U P L L U P L OH | 1594 |
| Hypomurocin_A_III | *Ac U Q V L U P L I U P L OH | 1595 |
| Hypomurocin_A_IV | *Ac U Q I V U P L L U P L OH | 1596 |
| Hypomurocin_A_V | *Ac U Q I I U P L L U P L OH | 1597 |
| Hypomurocin_A_Va | *Ac U Q I L U P L I U P L OH | 1598 |
| Hypomurocin_B_I | *Ac U S A L U Q U V U G U U P L U U Q V OH | 1599 |
| Hypomurocin_B_II | *Ac U S A L U Q U V U G U U P L U U Q L OH | 1600 |
| Hypomurocin_B_IIIa | *Ac U A A L U Q U V U G U U P L U U Q V OH | 1601 |
| Hypomurocin_B_IIIb | *Ac U S A L U Q J V U G U U P L U U Q V OH | 1602 |
| Hypomurocin_B_IV | *Ac U S A L U Q U V U G J U P L U U Q V OH | 1603 |
| Hypomurocin_B_V | *Ac U S A L U Q U V U G J U P L U U Q L OH | 1604 |
| Leu1_Zervamicin | *Ac L I Q J I T U L U O Q U O U P F OH | 1605 |
| Longibrachin_A_I | *Ac U A U A U A Q U V U G L U P V U U Q Q F OH | 1606 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Longibrachin_A_II | *Ac U A U A U A Q U V U G L U P V U J Q Q F OH | 1607 |
| Longibrachin_A_III | *Ac U A U A U U Q U V U G L U P V U U Q Q F OH | 1608 |
| Longibrachin_A_IV | *Ac U A U A U U Q U V U G L U P V U J Q Q F OH | 1609 |
| Longibrachin_B_II | *Ac U A U A U A Q U V U G L U P V U U E Q F OH | 1610 |
| Longibrachin_B_III | *Ac U A U A U A Q U V U G L U P V U J E Q F OH | 1611 |
| LP237_F5 | *Oc U P Y U Q Q U Zor Q A L OH | 1612 |
| LP237_F7 | *Ac U P F U Q Q U U Q A L OH | 1613 |
| LP237_F8 | *Oc U P F U Q Q U Zor Q A L OH | 1614 |
| NA_VII | *Ac U A A U J Q U U U S L U OCH3 | 1615 |
| Paracelsin_A | *Ac U A U A U A Q U V U G U U P V U U Q Q F OH | 1616 |
| Paracelsin_B | *Ac U A U A U A Q U L U G U U P V U U Q Q F OH | 1617 |
| Paracelsin_C | *Ac U A U A U U Q U V U G U U P V U U Q Q F OH | 1618 |
| Paracelsin_D | *Ac U A U A U U Q U L U G U U P V U U Q Q F OH | 1619 |
| Paracelsin_E | *Ac U A U A U A Q U L U G U A P V U U Q Q F OH | 1620 |
| Peptaibolin | *Ac L U L U F OH | 1621 |
| Peptaivirin_A | *Ac F U A U J L Q G U U A A U P J U U Q W OH | 1622 |
| Peptaivirin_B | *Ac F U S U J L Q G U U A A U P J U U Q F OH | 1623 |
| Polysporin_A | *Ac U P U A U U Q U V U G V U P V U U Q Q F OH | 1624 |
| Polysporin_B | *Ac U P U A U U Q U V U G L U P V U U Q Q F OH | 1625 |
| Polysporin_C | *Ac U P U A U U Q U I U G L U P V U U Q Q F OH | 1626 |
| Polysporin_D | *Ac U P U A U U Q U I U G L U P V U V Q Q F OH | 1627 |
| Pseudokinin_KLIII | *Ac U N I I U P L L U P NH2 | 1628 |
| Pseudokinin_KLVI | *Ac U N I I U P L V hydroxyketopiperazine | 1629 |
| Samarosporin_I | *Ac F U U U V G L U U O Q J O A F OH | 1630 |
| Samarosporin_II | *Ac F U U U V G L U U O Q J O U F OH | 1631 |
| Saturnisporin_SA_I | *Ac U A U A U A Q U L U G U U P V U U Q Q F OH | 1632 |
| Saturnisporin_SA_II | *Ac U A U A U A Q U L U G U U P V U J Q Q F OH | 1633 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Saturnisporin_SA_III | *Ac U A U A U U Q U L U G U U P V U U Q Q F OH | 1634 |
| Saturnisporin_SA_IV | *Ac U A U A U U Q U L U G U U P V U J Q Q F OH | 1635 |
| Stilbellin_I | *Ac F U U U V G L U U O Q J O A F OH | 1636 |
| Stilbellin_II | *Ac F U U U V G L U U O Q J O U F OH | 1637 |
| Stilboflavin_A_1 | *Ac U P U A U A Q U V U G U U P V U U E Q V OH | 1638 |
| Stilboflavin_A_2 | *Ac U P U A U A Q U L U G U U P V U U E Q V OH | 1639 |
| Stilboflavin_A_3 | *Ac U P U A U U Q U V U G U A P V U U E Q L OH | 1640 |
| Stilboflavin_A_4 | *Ac U P U A U A Q U L U G U U P V U U E Q L OH | 1641 |
| Stilboflavin_A_5 | *Ac U P U A U U Q U L U G U U P V U U E Q V OH | 1642 |
| Stilboflavin_A_6 | *Ac U P U A U A Q U L U G U U P V U U E Q J OH | 1643 |
| Stilboflavin_A_7 | *Ac U P U A U U Q U L U G U U P V U U E Q I OH | 1644 |
| Stilboflavin_B_1 | *Ac U P U A U A Q U V U G U U P V U U Q Q V OH | 1645 |
| Stilboflavin_B_2 | *Ac U P U A U A Q U L U G U U P V U U Q Q V OH | 1646 |
| Stilboflavin_B_3 | *Ac U P U A U A Q U V U G U U P V U U Q Q L OH | 1647 |
| Stilboflavin_B_4 | *Ac U P U A U A Q U L U G U U P V U U Q Q L OH | 1648 |
| Stilboflavin_B_5 | *Ac U P U A U U Q U L U G U U P V U U Q Q V OH | 1649 |
| Stilboflavin_B_6 | *Ac U P U A U U Q U V U G U U P V U U Q Q V OH | 1650 |
| Stilboflavin_B_7 | *Ac U P U A U U Q U L U G U U P V U U Q Q L OH | 1651 |
| Stilboflavin_B_8 | *Ac U P U A U U Q U V U G U U P V U U Q Q L OH | 1652 |
| Stilboflavin_B_9 | *Ac U P U A U U Q U L U G U U P V U U Q Q I OH | 1653 |
| Stilboflavin_B_10 | *Ac U P U A U U Q U V U G U U P V U U Q Q I OH | 1654 |
| Suzukacillin | *Ac U A U A U A Q U U U G L U P V U U Q Q F OH | 1655 |
| Trichobrachin_A-I | *Ac U N L L U P L U U P L OH | 1656 |
| Trichobrachin_A-II | *Ac U N L L U P V L U P V OH | 1657 |
| Trichobrachin_A-III | *Ac U N V L U P L L U P V OH | 1658 |
| Trichobrachin_A-IV | *Ac U N L V U P L L U P V OH | 1659 |
| Trichobrachin_B-I | *Ac U N L L U P V U V P L OH | 1660 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Trichobrachin_B-II | *Ac U N V L U P L U V P L OH | 1661 |
| Trichobrachin_B-III | *Ac U N L V U P L U V P L OH | 1662 |
| Trichobrachin_B-IV | *Ac U N L L U P L U V P V OH | 1663 |
| Trichocellin_TC-A-I | *Ac U A U A U A Q U L U G U U P V U U Q Q F OH | 1664 |
| Trichocellin_TC-A-II | *Ac U A U A U A Q U L U G U U P V U J Q Q F OH | 1665 |
| Trichocellin_TC-A-III | *Ac U A U A U A Q U I U G U U P V U U Q Q F OH | 1666 |
| Trichocellin_TC-A-IV | *Ac U A U A U A Q U I U G U U P V U J Q Q F OH | 1667 |
| Trichocellin_TC-A-V | *Ac U A U A U A Q U L U G L U P V U U Q Q F OH | 1668 |
| Trichocellin_TC-A-VI | *Ac U A U A U A Q U L U G L U P V U J Q Q F OH | 1669 |
| Trichocellin_TC-A-VII | *Ac U A U A U A Q U I U G L U P V U U Q Q F OH | 1670 |
| Trichocellin_TC-A-VIII | *Ac U A U A U A Q U I U G L U P V U J Q Q F OH | 1671 |
| Trichocellin_TC-B-I | *Ac U A U A U A Q U L U G U U P V U U E Q F OH | 1672 |
| Trichocellin_TC-B-II | *Ac U A U A U A Q U L U G U U P V U J E Q F OH | 1673 |
| Trichodecenin_TD_I | *(Z)-4-decenoyl G G L U G I L OH | 1674 |
| Trichodecenin_TD_II | *(Z)-4-decenoyl G G L U G L L OH | 1675 |
| Trichogin_A_IV | *Oc U G L U G G L U G I L OH | 1676 |
| Trichokindin_Ia | *Ac U S A U U Q J L U A U U P L U U Q I OH | 1677 |
| Trichokindin_Ib | *Ac U S A U J Q U L U A U U P L U U Q I OH | 1678 |
| Trichokindin_IIa | *Ac U S A U U Q U L U A J U P L U U Q I OH | 1679 |
| Trichokindin_IIb | *Ac U S A U J Q J L U A U U P L U U Q L OH | 1680 |
| Trichokindin_IIIa | *Ac U S A U U Q J L U A J U P L U U Q L OH | 1681 |
| Trichokindin_IIIb | *Ac U S A U J Q J L U A J U P L U U Q L OH | 1682 |
| Trichokindin_IV | *Ac U S A U J Q J L U A U U P L U U Q I OH | 1683 |
| Trichokindin_Va | *Ac U S A U U Q J L U A J U P L U U Q I OH | 1684 |
| Trichokindin_Vb | *Ac U S A U J Q U L U A J U P L U U Q I OH | 1685 |
| Trichokindin_VI | *Ac U S A U J Q J L U A J U P L U U Q L OH | 1686 |
| Trichokindin_VII | *Ac U S A U J Q J L U A J U P L U U Q I OH | 1687 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Trichokonin_Ia | *Ac U A U A U A Q U V U G L A P V U U Q Q F OH | 1688 |
| Trichokonin_Ib | *Ac U G U A U A Q U V U G L U P V U U Q Q F OH | 1689 |
| Trichokonin_IIa | *Ac U A U A U A Q U V U G L U P A U U Q Q F OH | 1690 |
| Trichokonin_IIb | *Ac A A U A U A Q U V U G L U P V U U Q Q F OH | 1691 |
| Trichokonin_IIc | *Ac U A A A U A Q U V U G L U P V U U Q Q F OH | 1692 |
| Trichokonin_V | *Ac U A U A U Q U V U G L U P V U U Q Q F OH | 1693 |
| Trichokonin_VII | *Ac U A U A U A Q U V U G L U P V U J Q Q F OH | 1694 |
| Trichokonin_VIII | *Ac U A U A U U Q U V U G L U P V U U Q Q F OH | 1695 |
| Trichokonin_IX | *Ac U A U A U A Q U V U G L U P V U J Q Q F OH | 1696 |
| Tricholongin_BI | *Ac U G F U U Q U U U S L U P V U U Q Q L OH | 1697 |
| Tricholongin_BII | *Ac U G F U U Q U U U S L U P V U J Q Q L OH | 1698 |
| Trichopolyn_I | *Fa P ZZ A U U I A U U AMAE | 1699 |
| Trichopolyn_II | *Fa P ZZ A U U V A U U AMAE | 1700 |
| Trichopolyn_III | *Fa P ZZ A U U I A U A AMAE | 1701 |
| Trichopolyn_IV | *Fa P ZZ A U U V A U A AMAE | 1702 |
| Trichopolyn_V | *Fa' P ZZ A U U I A U U AMAE | 1703 |
| Trichorovin_TV_Ia | *Ac U N V Lx U P Lx Lx U P V OH | 1704 |
| Trichorovin_TV_Ib | *Ac U N V V U P Lx Lx U P Lx OH | 1705 |
| Trichorovin_TV_IIa | *Ac U N V V U P Lx Lx U P Lx OH | 1706 |
| Trichorovin_TV_IIb | *Ac U N Lx V U P Lx Lx U P V OH | 1707 |
| Trichorovin_TV_IIIa | *Ac U Q V V U P Lx Lx U P Lx OH | 1708 |
| Trichorovin_TV_IIIb | *Ac U Q V Lx U P Lx Lx U P V OH | 1709 |
| Trichorovin_TV_IVa | *Ac U Q V V U P Lx Lx U P Lx OH | 1710 |
| Trichorovin_TV_IVb | *Ac U Q Lx V U P Lx Lx U P V OH | 1711 |
| Trichorovin_TV_IVc | *Ac U N V Lx U P Lx Lx U P Lx OH | 1712 |
| Trichorovin_TV_IXa | *Ac U Q V Lx U P Lx Lx U P Lx OH | 1713 |
| Trichorovin_TV_IXb | *Ac U Q Lx Lx U P Lx Lx U P V OH | 1714 |
| Trichorovin_TV_Va | *Ac U N V Lx U P Lx Lx U P Lx OH | 1715 |
| Trichorovin_TV_Vb | *Ac U N Lx Lx U P Lx Lx U P V OH | 1716 |
| Trichorovin_TV_VIa | *Ac U N V Lx U P Lx Lx U P Lx OH | 1717 |
| Trichorovin_TV_VIb | *Ac U N Lx Lx U P Lx Lx U P V OH | 1718 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Trichorovin_TV_VIIa | *Ac U N Lx V U P Lx Lx U P Lx OH | 1719 |
| Trichorovin_TV_VIIb | *Ac U Q V Lx U P Lx Lx U P V OH | 1720 |
| Trichorovin_TV_VIII | *Ac U Q V Lx U P Lx Lx U P Lx OH | 1721 |
| Trichorovin_TV_Xa | *Ac U Q Lx V U P Lx Lx U P Lx OH | 1722 |
| Trichorovin_TV_Xb | *Ac U N Lx Lx U P Lx Lx U P Lx OH | 1723 |
| Trichorovin_TV_XIIa | *Ac U N I I U P L L U P I OH | 1724 |
| Trichorovin_TV_XIIb | *Ac U N Lx Lx U P Lx Lx U P L OH | 1725 |
| Trichorovin_TV_XIII | *Ac U Q Lx Lx U P Lx Lx U P Lx OH | 1726 |
| Trichorovin_TV_XIV | *Ac U Q Lx Lx U P Lx Lx U P Lx OH | 1727 |
| Trichorozin_I | *Ac U N I L U P I L U P V OH | 1728 |
| Trichorozin_II | *Ac U Q I L U P I L U P V OH | 1729 |
| Trichorozin_III | *Ac U N I L U P I L U P L OH | 1730 |
| Trichorozin_IV | *Ac U Q I L U P I L U P L OH | 1731 |
| Trichorzianine_TA_IIIc | *Ac U A A U U Q U U U S L U P V U I Q Q W OH | 1732 |
| Trichorzianine_TB_IIa | *Ac U A A U U Q U U U S L U P L U I Q E W OH | 1733 |
| Trichorzianine_TB_IIIc | *Ac U A A U U Q U U U S L U P V U I Q E W OH | 1734 |
| Trichorzianine_TB_IVb | *Ac U A A U J Q U U U S L U P V U I Q E W OH | 1735 |
| Trichorzianine_TB_Vb | *Ac U A A U U Q U U U S L U P L U I Q E F OH | 1736 |
| Trichorzianine_TB_VIa | *Ac U A A U J Q U U U S L U P L U I Q E F OH | 1737 |
| Trichorzianine_TB_VIb | *Ac U A A U U Q U U U S L U P V U I Q E F OH | 1738 |
| Trichorzianine_TB_VII | *Ac U A A U J Q U U U S L U P V U I Q E F OH | 1739 |
| Trichorzin_HA_I | *Ac U G A U U Q U V U G L U P L U U Q L OH | 1740 |
| Trichorzin_HA_II | *Ac U G A U U Q U V U G L U P L U J Q L OH | 1741 |
| Trichorzin_HA_III | *Ac U G A U J Q U V U G L U P L U U Q L OH | 1742 |
| Trichorzin_HA_V | *Ac U G A U J Q U V U G L U P L U J Q L OH | 1743 |
| Trichorzin_HA_VI | *Ac U G A U J Q J V U G L U P L U J Q L OH | 1744 |
| Trichorzin_HA_VII | *Ac U G A U J Q V V U G L U P L U J Q L OH | 1745 |
| Trichorzin_MA_I | *Ac U S A U U Q U L U G L U P L U U Q V OH | 1746 |
| Trichorzin_MA_II | *Ac U S A U J Q U L U G L U P L U U Q V OH | 1747 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Trichorzin_MA_III | *Ac U S A U J Q J L U G L U P L U U Q V OH | 1748 |
| Trichorzin_PA_II | *Ac U S A U J Q U V U G L U P L U U Q W OH | 1749 |
| Trichorzin_PA_IV | *Ac U S A U J Q J V U G L U P L U U Q W OH | 1750 |
| Trichorzin_PA_V | *Ac U S A J J Q U V U G L U P L U U Q W OH | 1751 |
| Trichorzin_PA_VI | *Ac U S A U J Q U V U G L U P L U U Q F OH | 1752 |
| Trichorzin_PA_VII | *Ac U S A J J Q U V U G L U P L U U Q W OH | 1753 |
| Trichorzin_PA_VIII | *Ac U S A U J Q J V U G L U P L U U Q F OH | 1754 |
| Trichorzin_PA_IX | *Ac U S A J J Q U V U G L U P L U U Q F OH | 1755 |
| Trichorzin_PAU4 | *Ac U S A U U Q U V U G L U P L U U Q W OH | 1756 |
| Trichosporin_TS-B-1a-1 | *Ac U A G U A U Q U Lx A A Vx A P V U Vx Q Q F OH | 1757 |
| Trichosporin_TS-B-1a-2 | *Ac U A G A U U Q U Lx A A Vx A P V U Vx Q Q F OH | 1758 |
| Trichosporin_TS-B-1b | *Ac U A G A U U Q U Lx U G Lx A P V U A Q Q F OH | 1759 |
| Trichosporin_TS-B-1d | *Ac U A S A U U Q U Lx U G Lx A P V U U Q Q F OH | 1760 |
| Trichosporin_TS-B-1e | *Ac U A G A U U Q U Lx U G Lx U P V U U Q Q F OH | 1761 |
| Trichosporin_TS-B-1f | *Ac U A S A U U Q U Lx U G Lx U P V U U Q Q F OH | 1762 |
| Trichosporin_TS-B-1g | *Ac U A G A U U Q U Lx U G Lx A P V U U Q Q F OH | 1763 |
| Trichosporin_TS-B-1h | *Ac U A G A U U Q U Lx U G Lx U P V U Vx Q Q F OH | 1764 |
| Trichosporin_TS-B-Ia | *Ac U A S A U U Q U L U G L U P V U U Q Q F OH | 1765 |
| Trichosporin_TS-B-IIIa | *Ac U A A A U U Q U L U G L U P V U U Q Q F OH | 1766 |
| Trichosporin_TS-B-IIIb | *Ac U A A A U U Q U I U G L U P V U A Q Q F OH | 1767 |
| Trichosporin_TS-B-IIIc | *Ac U A A A A U Q U I U G L U P V U U Q Q F OH | 1768 |
| Trichosporin_TS-B-IIId | *Ac U A A A U U Q U V U G L U P V U U Q Q F OH | 1769 |
| Trichosporin_TS-B-IVb | *Ac U A A A U U Q U L U G L U P V U J Q Q F OH | 1770 |
| Trichosporin_TS-B-IVc | *Ac U A U A U U Q U V U G L U P V U U Q Q F OH | 1771 |
| Trichosporin_TS-B-IVd | *Ac U A A A U U Q U V U G L U P V U J Q Q F OH | 1772 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Trichosporin_TS-B-V | *Ac U A A A U U Q U I U G L U P V U U Q Q F OH | 1773 |
| Trichosporin_TS-B-VIa | *Ac U A U A U U Q U I U G L U P V U U Q Q F OH | 1774 |
| Trichosporin_TS-B-VIb | *Ac U A A A U U Q U I U G L U P V U J Q Q F OH | 1775 |
| Trichotoxin_A-40 | *Ac U G U L U E U U U A U U P L U J Q V OH | 1776 |
| Trichotoxin_A-40_I | *Ac U G U L U Q U U A A U U P L U U E V OH | 1777 |
| Trichotoxin_A-40_II | *Ac U G U L U Q U U U A A U P L U U E V OH | 1778 |
| Trichotoxin_A-40_III | *Ac U G U L U Q U U A A U U P L U J E V OH | 1779 |
| Trichotoxin_A-40_IV | *Ac U G U L U Q U U U A U U P L U U E V OH | 1780 |
| Trichotoxin_A-40_V | *Ac U G U L U Q U U U A U U P L U J E V OH | 1781 |
| Trichotoxin_A-40_Va | *Ac U A U L U Q U U U A U U P L U U E V OH | 1782 |
| Trichotoxin_A-50_E | *Ac U G U L U Q U U U A A U P L U U Q V OH | 1783 |
| Trichotoxin_A-50_F | *Ac U G U L U Q U U A A A U P L U J Q V OH | 1784 |
| Trichotoxin_A-50_G | *Ac U G U L U Q U U U A A U P L U J Q V OH | 1785 |
| Trichotoxin_A-50_H | *Ac U A U L U Q U U U A A U P L U J Q V OH | 1786 |
| Trichotoxin_A-50_I | *Ac U G U L U Q U U U A U U P L U J Q V OH | 1787 |
| Trichotoxin_A-50_J | *Ac U A U L U Q U U U A U U P L U J Q V OH | 1788 |
| Trichovirin-Ia | *Ac U G A L A Q Vx V U G U U P L U U Q L OH | 1789 |
| Trichovirin-Ib | *Ac U G A L U Q A V U G J U P L U U Q L OH | 1790 |
| Trichovirin-IIa | *Ac U G A L A Q U V U G J U P L U U Q L OH | 1791 |
| Trichovirin-IIb | *Ac U G A L U Q U V U G U U P L U U Q L OH | 1792 |
| Trichovirin-IIc | *Ac U G A L U Q Vx V U G U U P L U U Q L OH | 1793 |
| Trichovirin-IIIa | *Ac U G A L U Q J V U G U U P L U U Q L OH | 1794 |
| Trichovirin-IIIb | *Ac U G A L J Q J U U G U U P L U U Q L OH | 1795 |
| Trichovirin-IVa | *Ac U G A L J Q J V U G U U P L U U Q L OH | 1796 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| Trichovirin-IVb | *Ac U G A L U Q U V U G J U P L U U Q L OH | 1797 |
| Trichovirin-V | *Ac U G A L U Q J V U G J U P L U U Q L OH | 1798 |
| Trichovirin-VIa | *Ac U G A L U Q J L U G J U P L U U Q L OH | 1799 |
| Trichovirin-VIb | *Ac U G A L J Q J V U G J U P L U U Q L OH | 1800 |
| Trikoningin_KA_V | *Ac U G A U I Q U U U S L U P V U I Q Q L OH | 1801 |
| Trikoningin_KB_I | *Oc U G V U G G V U G I L OH | 1802 |
| Trikoningin_KB_II | *Oc J G V U G G V U G I L OH | 1803 |
| Tylopeptin_A | *Ac W V U J A Q A U S U A L U Q L OH | 1804 |
| Tylopeptin_B | *Ac W V U U A Q A U S U A L U Q L OH | 1805 |
| XR586 | *Ac W J Q U I T U L U P Q U O J P F G OH | 1806 |
| Zervamicin_A-1-16 | *Boc W I A U I V U L U P A U P U P F OCH3 | 1807 |
| Zervamicin_ZIA | *Ac W I E J V T U L U O Q U O U P F OH | 1808 |
| Zervamicin_ZIB | *Ac W V E J I T U L U O Q U O U P F OH | 1809 |
| Zervamicin_ZIB' | *Ac W I E U I T U L U O Q U O U P F OH | 1810 |
| Zervamicin_ZIC | *Ac W I E J I T U L U O Q U O U P F OH | 1811 |
| Zervamicin_ZII-1 | *Ac W I Q U V T U L U O Q U O U P F OH | 1812 |
| Zervamicin_ZII-2 | *Ac W I Q U I T U V U O Q U O U P F OH | 1813 |
| Zervamicin_ZII-3 | *Ac W V Q U I T U L U O Q U O U P F OH | 1814 |
| Zervamicin_ZII-4 | *Ac W I Q J V T U L U O Q U O U P F OH | 1815 |
| Zervamicin_ZII-5 | *Ac W I Q J I T U V U O Q U O U P F OH | 1816 |
| Zervamicin_ZIIA | *Ac W I Q U I T U L U O Q U O U P F OH | 1817 |
| Zervamicin_ZIIB | *Ac W I Q J I T U L U O Q U O U P F OH | 1818 |
| CAMEL135 (CAM135) | GWRLIKKILRVFKGL | 1819 |
| Novispirin G2 | KNLRIIRKGIHIIKKY* | 1820 |
| B-33 | FKKFWKWFRRF | 1821 |
| B-34 | LKRFLKWFKRF | 1822 |
| B-35 | KLFKRWKHLFR | 1823 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| B-36 | RLLKRFKHLFK | 1824 |
| B-37 | FKTFLKWLHRF | 1825 |
| B-38 | IKQLLHFFQRF | 1826 |
| B-39 | KLLQTFKQIFR | 1827 |
| B-40 | RILKELKNLFK | 1828 |
| B-41 | LKQFVHFIHRF | 1829 |
| B-42 | VKTLLHIFQRF | 1830 |
| B-43 | KLVEQLKEIFR | 1831 |
| B-44 | RVLQEIKQILK | 1832 |
| B-45 | VKNLAELVHRF | 1833 |
| B-46 | ATHLLHALQRF | 1834 |
| B-47 | KLAENVKEILR | 1835 |
| B-48 | RALHEAKEALK | 1836 |
| B-49 | FHYFWHWFHRF | 1837 |
| B-50 | LYHFLHWFQRF | 1838 |
| B-51 | YLFQTWQHLFR | 1839 |
| B-52 | YLLTEFQHLFK | 1840 |
| B-53 | FKTFLQWLHRF | 1841 |
| B-54 | IKTLLHFFQRF | 1842 |
| B-55 | KLLQTFNQIFR | 1843 |
| B-56 | TILQSLKNIFK | 1844 |
| B-57 | LKQFVKFIHRF | 1845 |
| B-58 | VKQLLKIFNRF | 1846 |
| B-59 | KLVQQLKNIFR | 1847 |
| B-60 | RVLNQVKQILK | 1848 |
| B-61 | VKKLAKLVRRF | 1849 |
| B-62 | AKRLLKVLKRF | 1850 |
| B-63 | KLAQKVKRVLR | 1851 |
| B-64 | RALKRIKHVLK | 1852 |
| 1C-1 | RRRRWWW | 1853 |
| 1C-2 | RRWWRRW | 1854 |
| 1C-3 | RRRWWWR | 1855 |
| 1C-4 | RWRWRWR | 1856 |
| 2C-1 | RRRFWWR | 1857 |
| 2C-2 | RRWWRRF* | 1858 |
| 2C-3 | RRRWWWF* | 1859 |
| 2C-4 | RWRWRWF* | 1860 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
|---|---|---|
| 3C-1 | RRRRWWK | 1861 |
| 3C-2 | RRWWRRK | 1862 |
| 3C-3 | RRRWWWK | 1863 |
| 3C-4 | RWRWRWK | 1864 |
| 4C-1 | RRRKWWK | 1865 |
| 4C-2 | RRWKRRK | 1866 |
| 4C-3 | RRRKWWK | 1867 |
| 4C-4 | RWRKRWK | 1868 |
| a-3 | LHLLHQLLHLLHQF* | 1869 |
| a-4 | AQAAHQAAHAAHQF* | 1870 |
| a-5 | KLKKLLKKLKKLLK | 1871 |
| a-6 | LKLLKKLLKLLKKF* | 1872 |
| a-7 | LQLLKQLLKLLKQF* | 1873 |
| a-8 | AQAAKQAAKAAKQF* | 1874 |
| a-9 | RWRRWWRHFHHFFH* | 1875 |
| a-10 | KLKKLLKRWRRWWR | 1876 |
| a-11 | RWRRLLKKLHHLLH* | 1877 |
| a-12 | KLKKLLKHLHHLLH* | 1878 |
| BD-1 | FVF RHK WVW KHR FLF | 1879 |
| BD-2 | VFI HRH VWV HKH VLF | 1880 |
| BD-3 | WR WR AR WR WR LR WR F | 1881 |
| BD-4 | WR IH LR AR LH VK FR F | 1882 |
| BD-5 | LR IH AR FK VH IR LK F | 1883 |
| BD-6 | FH IK FR VH LK VR FH F | 1884 |
| BD-7 | FH VK IH FR LH VK FH F | 1885 |
| BD-8 | LH IH AH FH VH IH LH F | 1886 |
| BD-9 | FK IH FR LK VH IR FK F | 1887 |
| BD-10 | FK AH IR FK LR VK FH F | 1888 |
| BD-11 | LK AK IK FK VK LK IK F | 1889 |
| BD-12 | WIW KHK FL HRH FLF | 1890 |
| BD-13 | VFL HRH VI KHK LVF | 1891 |
| BD-14 | FL HKH VL RHR IVF | 1892 |
| BD-15 | VF KHK IV HRH ILF | 1893 |
| BD-16 | FLF KH LFL HR IFF | 1894 |
| BD-17 | LF KH ILI HR VIF | 1895 |
| BD-18 | FL HKH LF KHK LF | 1896 |
| BD-19 | VF RHR FI HRH VF | 1897 |

TABLE 10-continued

Other illustrative antimicrobial peptides. AP numbers refer to ID in antimicrobial peptide database (aps.unmc.edu/AP/main.php).

| Effector | Structure/Sequence | SEQ ID No |
| --- | --- | --- |
| BD-20 | FI HK LV HKH VLF | 1898 |
| BD-21 | VL RH LF RHR IVF | 1899 |
| BD-22 | LV HK LIL RH LLF | 1900 |
| BD-23 | VF KR VLI HK LIF | 1901 |
| BD-24 | IV RK FLF RHK VF | 1902 |
| BD-25 | VL KH VIA HKR LF | 1903 |
| BD-26 | FI RK FLF KH LF | 1904 |
| BD-27 | VI RH VWV RK LF | 1905 |
| BD-28 | FLF RHR F RHR LVF | 1906 |
| BD-29 | LFL HKH A KHK FLF | 1907 |
| BD-30 | F KHK F KHK FIF | 1908 |
| BD-31 | L RHR L RHR LIF | 1909 |
| BD-32 | LIL K FLF K FVF | 1910 |
| BD-33 | VLI R ILV R VIF | 1911 |
| BD-34 | F RHR F RHR F | 1912 |
| BD-35 | L KHK L KHK F | 1913 |
| BD-36 | F K F KHK LIF | 1914 |
| BD-37 | L R L RHR VLF | 1915 |
| BD-38 | F K FLF K FLF | 1916 |
| BD-39 | L R LFL R WLF | 1917 |
| BD-40 | F K FLF KHK F | 1918 |
| BD-41 | L R LFL RHR F | 1919 |
| BD-42 | F K FLF K F | 1920 |
| BD-43 | L R LFL R F | 1921 |
| AA-1 | HHFFHHFHHFFHHF* | 1922 |
| AA-2 | FHFFHHFFHFFHHF* | 1923 |
| AA-3 | KLLK-GAT-FHFFHHFFHFFHHF | 1924 |
| AA-4 | KLLK-FHFFHHFFHFFHHF | 1925 |

TABLE 10-continued

Other illustrative antimicrobial peptides. AP numbers refer to ID in
antimicrobial peptide database (aps.unmc.edu/AP/main.php).

| Effector | Structure/Sequence | SEQ ID No |
|---|---|---|
| AA-5 | FHFFHHFFHFFHHFKLLK | 1926 |
| RIP | YSPWTNF* | 1927 |

Abreviations:
Oc - Octyl;
Fa - 2-methyloctanoyl (MOA) (helioferins),
(2R) - methyldecanoyl (MDA) (trichopolyns);
Fa' - 3-hydroxy-2-methyldecanoic acid (HMDA);
ZZ - 2-amino-4-methyl-6-hydroxy-8-oxo-decanoic acid (AHMOD);
AAE - 2-(2'-aminopropyl)-aminoethanol;
AMAE - 2-[(2'-aminopropyl)-methylamino]-ethanol;
Boc - N-((1,1-dimethylethoxy)carbonyl);
U - Aminoisobutyric Acid (Aib);
J - Isovaline (Iva);
O - Hydroxyproline (Hyp);
Z - Ethylnorvaline (EtNor);
x or xx means L or I at that position;
Ac - optionally acetylated N-term;
OH, OCH3 - optional C-term;
Alkane long chains are noted in brackets;
*optionally amidated C-terminus.

A number of antimicrobial peptides are also disclosed in U.S. Pat. Nos. 7,271,239, 7,223,840, 7,176,276, 6,809,181, 6,699,689, 6,420,116, 6,358,921, 6,316,594, 6,235,973, 6,183,992, 6,143,498, 6,042,848, 6,040,291, 5,936,063, 5,830,993, 5,428,016, 5,424,396, 5,032,574, 4,623,733, which are incorporated herein by reference for the disclosure of particular antimicrobial peptides.

Ligands.

In certain embodiments the effector can comprise one or more ligands, epitope tags, and/or antibodies. In certain embodiments preferred ligands and antibodies include those that bind to surface markers on immune cells. Chimeric moieties utilizing such antibodies as effector molecules act as bifunctional linkers establishing an association between the immune cells bearing binding partner for the ligand or antibody and the target microorganism(s).

The term "epitope tag" or "affinity tag" are used interchangeably herein, and as used refers to a molecule or domain of a molecule that is specifically recognized by an antibody or other binding partner. The term also refers to the binding partner complex as well. Thus, for example, biotin or a biotin/avidin complex are both regarded as an affinity tag. In addition to epitopes recognized in epitope/antibody interactions, affinity tags also comprise "epitopes" recognized by other binding molecules (e.g. ligands bound by receptors), ligands bound by other ligands to form heterodimers or homodimers, $His_6$ bound by Ni-NTA, biotin bound by avidin, streptavidin, or anti-biotin antibodies, and the like.

Epitope tags are well known to those of skill in the art. Moreover, antibodies specific to a wide variety of epitope tags are commercially available. These include but are not limited to antibodies against the DYKDDDDK (SEQ ID NO:1928) epitope, c-myc antibodies (available from Sigma, St. Louis), the HNK-1 carbohydrate epitope, the HA epitope, the HSV epitope, the $His_4$ (SEQ ID NO:1929), $His_5$ (SEQ ID NO:1930), and $His_6$ (SEQ ID NO:1931) epitopes that are recognized by the His epitope specific antibodies (see, e.g., Qiagen), and the like. In addition, vectors for epitope tagging proteins are commercially available. Thus, for example, the pCMV-Tag1 vector is an epitope tagging vector designed for gene expression in mammalian cells. A target gene inserted into the pCMV-Tag1 vector can be tagged with the FLAG® epitope (N-terminal, C-terminal or internal tagging), the c-myc epitope (C-terminal) or both the FLAG (N-terminal) and c-myc (C-terminal) epitopes.

Lipids and Liposomes.

In certain embodiments the effectors comprise one or more microparticles or nanoparticles that can be loaded with an effector agent (e.g., a pharmaceutical, a label, etc.). In certain embodiments the microparticles or nanoparticles are lipidic particles. Lipidic particles are microparticles or nanoparticles that include at least one lipid component forming a condensed lipid phase. Typically, a lipidic nanoparticle has preponderance of lipids in its composition. Various condensed lipid phases include solid amorphous or true crystalline phases; isomorphic liquid phases (droplets); and various hydrated mesomorphic oriented lipid phases such as liquid crystalline and pseudocrystalline bilayer phases (L-alpha, L-beta, P-beta, Lc), interdigitated bilayer phases, and nonlamellar phases (see, e.g., The Structure of Biological Membranes, ed. by P. Yeagle, CRC Press, Boca Raton, Fla., 1991). Lipidic microparticles include, but are not limited to a liposome, a lipid-nucleic acid complex, a lipid-drug complex, a lipid-label complex, a solid lipid particle, a microemulsion droplet, and the like. Methods of making and using these types of lipidic microparticles and nanoparticles, as well as attachment of affinity moieties, e.g., antibodies, to them are known in the art (see, e.g., U.S. Pat. Nos. 5,077,057; 5,100,591; 5,616,334; 6,406,713; 5,576,016; 6,248,363; Bondi et al. (2003) *Drug Delivery* 10: 245-250; Pedersen et al., (2006) *Eur. J. Pharm. Biopharm.* 62: 155-162, 2006 (solid lipid particles); U.S. Pat. Nos. 5,534,502; 6,720,001; Shiokawa et al. (2005) *Clin. Cancer Res.* 11: 2018-2025 (microemulsions); U.S. Pat. No. 6,071,533 (lipid-nucleic acid complexes), and the like).

A liposome is generally defined as a particle comprising one or more lipid bilayers enclosing an interior, typically an aqueous interior. Thus, a liposome is often a vesicle formed by a bilayer lipid membrane. There are many methods for the preparation of liposomes. Some of them are used to prepare small vesicles (d<0.05 micrometer), some for larger vesicles (d>0.05 micrometer). Some are used to prepare multilamellar vesicles, some for unilamellar ones. Methods for liposome preparation are exhaustively described in several review articles such as Szoka and Papahadjopoulos (1980) *Ann. Rev. Biophys. Bioeng.*, 9: 467, Deamer and Uster (1983) Pp. 27-51 In: *Liposomes*, ed. M. J. Ostro, Marcel Dekker, New York, and the like.

In various embodiments the liposomes include a surface coating of a hydrophilic polymer chain. "Surface-coating" refers to the coating of any hydrophilic polymer on the surface of liposomes. The hydrophilic polymer is included in the liposome by including in the liposome composition one or more vesicle-forming lipids derivatized with a hydrophilic polymer chain. In certain embodiments, vesicle-forming lipids with diacyl chains, such as phospholipids, are preferred. One illustrative phospholipid is phosphatidylethanolamine (PE), which contains a reactive amino group convenient for coupling to the activated polymers. One illustrative PE is distearoyl PE (DSPE). Another example is non-phospholipid double chain amphiphilic lipids, such as diacyl- or dialkylglycerols, derivatized with a hydrophilic polymer chain.

In certain embodiments a hydrophilic polymer for use in coupling to a vesicle forming lipid is polyethyleneglycol (PEG), preferably as a PEG chain having a molecular weight between 1,000-10,000 Daltons, more preferably between 1,000-5,000 Daltons, most preferably between 2,000-5,000 Daltons. Methoxy or ethoxy-capped analogues of PEG are also useful hydrophilic polymers, commercially available in a variety of polymer sizes, e.g., 120-20,000 Daltons.

Other hydrophilic polymers that can be suitable include, but are not limited to polylactic acid, polyglycolic acid, polyvinylpyrrolidone, polymethyloxazoline, polyethyloxazoline, polyhydroxypropyl methacrylamide, polymethacrylamide, polydimethylacrylamide, and derivatized celluloses, such as hydroxymethylcellulose or hydroxyethylcellulose.

Preparation of lipid-polymer conjugates containing these polymers attached to a suitable lipid, such as PE, have been described, for example in U.S. Pat. No. 5,395, The liposomes can, optionally be prepared for attachment to one or more targeting moieties described herein. Here the lipid component included in the liposomes would include either a lipid derivatized with the targeting moiety, or a lipid having a polar-head chemical group, e.g., on a linker, that can be derivatized with the targeting moiety in preformed liposomes, according to known methods.

Methods of functionalizing lipids and liposomes with affinity moieties such as antibodies are well known to those of skill in the art (see, e.g., DE 3,218,121; Epstein et al. (1985) *Proc. Natl. Acad. Sci., USA*, 82:3688 (1985); Hwang et al. (1980) *Proc. Natl. Acad. Sci., USA*, 77: 4030; EP 52,322; EP 36,676; EP 88,046; EP 143,949; EP 142,641; Japanese patent application 83-118008; U.S. Pat. Nos. 4,485,045 and 4,544, 545; and EP 102,324, all of which are incorporated herein by reference).

Polymeric Microparticles and/or Nanoparticles.

In certain embodiments the effector(s) comprise polymeric microparticles and/or nanoparticles and/or micelles.

Microparticle and nanoparticle-based drug delivery systems have considerable potential for treatment of various microorganisms. Technological advantages of polymeric microparticles or nanoparticles used as drug carriers are high stability, high carrier capacity, feasibility of incorporation of both hydrophilic and hydrophobic substances, and feasibility of variable routes of administration, including oral application and inhalation. Polymeric nanoparticles can also be designed to allow controlled (sustained) drug release from the matrix. These properties of nanoparticles enable improvement of drug bioavailability and reduction of the dosing frequency.

Polymeric nanoparticles are typically micron or submicron (<1 μm) colloidal particles. This definition includes monolithic nanoparticles (nanospheres) in which the drug is adsorbed, dissolved, or dispersed throughout the matrix and nanocapsules in which the drug is confined to an aqueous or oily core surrounded by a shell-like wall. Alternatively, in certain embodiments, the drug can be covalently attached to the surface or into the matrix.

Polymeric microparticles and nanoparticles are typically made from biocompatible and biodegradable materials such as polymers, either natural (e.g., gelatin, albumin) or synthetic (e.g., polylactides, polyalkylcyanoacrylates), or solid lipids. In the body, the drug loaded in nanoparticles is usually released from the matrix by diffusion, swelling, erosion, or degradation. One commonly used material is poly(lactide-co-glycolide) (PLG).

Methods of fabricating and loading polymeric nanoparticles or microparticles are well known to those of skill in the art. Thus, for example, Matsumoto et al. (1999) *Intl. J. Pharmaceutics*, 185: 93-101 teaches the fabrication of poly(L-lactide)-poly(ethylene glycol)-poly(L-lactide) nanoparticles, Chawla et al. (2002) *Intl. J. Pharmaceutics* 249: 127-138, teaches the fabrication and use of poly(e-caprolactone) nanoparticles delivery of tamifoxen, and Bodmeier et al. (1988) *Intl. J. Pharmaceutics*, 43: 179-186, teaches the preparation of poly(D,L-lactide) microspheres using a solvent evaporation method." Intl. J. Pharmaceutics, 1988, 43, 179-186. Other nanoparticle formulations are described, for example, by Williams et al. (2003) *J. Controlled Release,* 91: 167-172; Leroux et al. (1996) *J. Controlled Release,* 39: 339-350; Soppimath et al. (2001) *J. Controlled Release*, 70:1-20; Brannon-Peppas (1995) *Intl. J. Pharmaceutics*, 116: 1-9; and the like.

Peptide Preparation.

The peptides described herein can be chemically synthesized using standard chemical peptide synthesis techniques or, particularly where the peptide does not comprise "D" amino acid residues, the peptide can be recombinantly expressed. Where the "D" polypeptides are recombinantly expressed, a host organism (e.g. bacteria, plant, fungal cells, etc.) can be cultured in an environment where one or more of the amino acids is provided to the organism exclusively in a D form. Recombinantly expressed peptides in such a system then incorporate those D amino acids.

In certain embodiments, D amino acids can be incorporated in recombinantly expressed peptides using modified amino acyl-tRNA synthetases that recognize D-amino acids.

In certain embodiments the peptides are chemically synthesized by any of a number of fluid or solid phase peptide synthesis techniques known to those of skill in the art. Solid phase synthesis in which the C-terminal amino acid of the sequence is attached to an insoluble support followed by sequential addition of the remaining amino acids in the sequence is a preferred method for the chemical synthesis of the polypeptides of this invention. Techniques for solid phase synthesis are well known to those of skill in the art and are described, for example, by Barany and Merrifield (1963) *Solid-Phase Peptide Synthesis*; pp. 3-284 *in The Peptides: Analysis, Synthesis, Biology. Vol. 2: Special Methods in Peptide Synthesis, Part A.*; Merrifield et al. (1963) *J. Am. Chem. Soc.,* 85: 2149-2156, and Stewart et al. (1984) *Solid Phase Peptide Synthesis,* 2nd ed. Pierce Chem. Co., Rockford, Ill.

In one embodiment, the peptides can be synthesized by the solid phase peptide synthesis procedure using a benzhydrylamine resin (Beckman Bioproducts, 0.59 mmol of $NH_2$/g of resin) as the solid support. The COOH terminal amino acid (e.g., t-butylcarbonyl-Phe) is attached to the solid support through a 4-(oxymethyl)phenacetyl group. This is a more stable linkage than the conventional benzyl ester linkage, yet the finished peptide can still be cleaved by hydrogenation. Transfer hydrogenation using formic acid as the hydrogen donor can be used for this purpose.

It is noted that in the chemical synthesis of peptides, particularly peptides comprising D amino acids, the synthesis usually produces a number of truncated peptides in addition to the desired full-length product. Thus, the peptides are typically purified using, e.g., HPLC.

D-amino acids, beta amino acids, non-natural amino acids, and the like can be incorporated at one or more positions in the peptide simply by using the appropriately derivatized amino acid residue in the chemical synthesis. Modified residues for solid phase peptide synthesis are commercially available from a number of suppliers (see, e.g., Advanced Chem Tech, Louisville; Nova Biochem, San Diego; Sigma, St Louis; Bachem California Inc., Torrance, etc.). The D-form and/or otherwise modified amino acids can be completely omitted or incorporated at any position in the peptide as desired. Thus, for example, in certain embodiments, the peptide can comprise a single modified acid, while in other embodiments, the peptide comprises at least two, generally at least three, more generally at least four, most generally at least five, preferably at least six, more preferably at least seven or even all modified amino acids. In certain embodiments, essentially every amino acid is a D-form amino acid.

As indicated above, the peptides and/or fusion proteins of this invention can also be recombinantly expressed. Accordingly, in certain embodiments, the antimicrobial peptides and/or targeting moieties, and/or fusion proteins of this invention are synthesized using recombinant expression systems. Generally this involves creating a DNA sequence that encodes the desired peptide or fusion protein, placing the DNA in an expression cassette under the control of a particular promoter, expressing the peptide or fusion protein in a host, isolating the expressed peptide or fusion protein and, if required, renaturing the peptide or fusion protein.

DNA encoding the peptide(s) or fusion protein(s) described herein can be prepared by any suitable method as described above, including, for example, cloning and restriction of appropriate sequences or direct chemical synthesis.

This nucleic acid can be easily ligated into an appropriate vector containing appropriate expression control sequences (e.g. promoter, enhancer, etc.), and, optionally, containing one or more selectable markers (e.g. antibiotic resistance genes).

The nucleic acid sequences encoding the peptides or fusion proteins described herein can be expressed in a variety of host cells, including, but not limited to, *E. coli*, other bacterial hosts, yeast, fungus, and various higher eukaryotic cells such as insect cells (e.g. SF3), the COS, CHO and HeLa cells lines and myeloma cell lines. The recombinant protein gene will typically be operably linked to appropriate expression control sequences for each host. For *E. coli* this can include a promoter such as the T7, trp, or lambda promoters, a ribosome binding site and preferably a transcription termination signal. For eukaryotic cells, the control sequences can include a promoter and often an enhancer (e.g., an enhancer derived from immunoglobulin genes, SV40, cytomegalovirus, etc.), and a polyadenylation sequence, and may include splice donor and acceptor sequences.

The plasmids can be transferred into the chosen host cell by well-known methods such as calcium chloride transformation for *E. coli* and calcium phosphate treatment or electroporation for mammalian cells. Cells transformed by the plasmids can be selected by resistance to antibiotics conferred by genes contained on the plasmids, such as the amp, gpt, neo and hyg genes.

Once expressed, the recombinant peptide(s) or fusion protein(s) can be purified according to standard procedures of the art, including ammonium sulfate precipitation, affinity columns, column chromatography, gel electrophoresis and the like (see, generally, R. Scopes, (1982) *Protein Purification*, Springer-Verlag, N.Y.; Deutscher (1990) *Methods in Enzymology Vol. 182: Guide to Protein Purification*., Academic Press, Inc. N.Y.). Substantially pure compositions of at least about 90 to 95% homogeneity are preferred, and 98 to 99% or more homogeneity are most preferred.

One of skill in the art would recognize that after chemical synthesis, biological expression, or purification, the peptide(s) or fusion protein(s) may possess a conformation substantially different than desired native conformation. In this case, it may be necessary to denature and reduce the peptide or fusion protein and then to cause the molecule to re-fold into the preferred conformation. Methods of reducing and denaturing proteins and inducing re-folding are well known to those of skill in the art (see, e.g., Debinski et al. (1993) *J. Biol. Chem.*, 268: 14065-14070; Kreitman and Pastan (1993) *Bioconjug. Chem.*, 4: 581-585; and Buchner, et al., (1992) *Anal. Biochem.*, 205: 263-270). Debinski et al., for example, describes the denaturation and reduction of inclusion body proteins in guanidine-DTE. The protein is then refolded in a redox buffer containing oxidized glutathione and L-arginine.

One of skill would recognize that modifications can be made to the peptide(s) and/or fusion protein(s) proteins without diminishing their biological activity. Some modifications may be made to facilitate the cloning, expression, or incorporation of the targeting molecule into a fusion protein. Such modifications are well known to those of skill in the art and include, for example, a methionine added at the amino terminus to provide an initiation site, or additional amino acids (e.g., poly His) placed on either terminus to create conveniently located restriction sites or termination codons or purification sequences.

Protecting Groups.

While the various peptides (e.g., targeting peptides, antimicrobial peptides, STAMPs) described herein may be shown with no protecting groups, in certain embodiments they can bear one, two, three, four, or more protecting groups. In various embodiments, the protecting groups can be coupled to the C- and/or N-terminus of the peptide(s) and/or to one or more internal residues comprising the peptide(s) (e.g., one or more R-groups on the constituent amino acids can be blocked). Thus, for example, in certain embodiments, any of the peptides described herein can bear, e.g., an acetyl group protecting the amino terminus and/or an amide group protecting the carboxyl terminus. One example of such a protected peptide is the 1845L6-21 STAMP having the amino acid sequence KFINGVLSQFVLERKPYP KLFKFLRKHLL* (SEQ ID NO:1953), where the asterisk indicates an amidated carboxyl terminus. Of course, this protecting group can be can be eliminated and/or substituted with another protecting group as described herein.

Without being bound by a particular theory, it was discovered that addition of a protecting group, particularly to the carboxyl and in certain embodiments the amino terminus can improve the stability and efficacy of the peptide.

A wide number of protecting groups are suitable for this purpose. Such groups include, but are not limited to acetyl, amide, and alkyl groups with acetyl and alkyl groups being particularly preferred for N-terminal protection and amide groups being preferred for carboxyl terminal protection. In certain particularly preferred embodiments, the protecting groups include, but are not limited to alkyl chains as in fatty acids, propionyl, formyl, and others. Particularly preferred carboxyl protecting groups include amides, esters, and ether-forming protecting groups. In one preferred embodiment, an acetyl group is used to protect the amino terminus and an amide group is used to protect the carboxyl terminus. These blocking groups enhance the helix-forming tendencies of the peptides. Certain particularly preferred blocking groups include alkyl groups of various lengths, e.g., groups having the formula: $CH_3$—$(CH_2)_n$—CO— where n ranges from about 1 to about 20, preferably from about 1 to about 16 or 18, more preferably from about 3 to about 13, and most preferably from about 3 to about 10.

In certain embodiments, the protecting groups include, but are not limited to alkyl chains as in fatty acids, propionyl, formyl, and others. Particularly preferred carboxyl protecting groups include amides, esters, and ether-forming protecting groups. In one embodiment, an acetyl group is used to protect the amino terminus and/or an amino group is used to protect the carboxyl terminus (i.e., amidated carboxyl terminus). In certain embodiments blocking groups include alkyl groups of various lengths, e.g., groups having the formula: $CH_3$—$(CH_2)_n$—CO— where n ranges from about 3 to about 20, preferably from about 3 to about 16, more preferably from about 3 to about 13, and most preferably from about 3 to about 10.

In certain embodiments, the acid group on the C-terminal can be blocked with an alcohol, aldehyde or ketone group and/or the N-terminal residue can have the natural amide group, or be blocked with an acyl, carboxylic acid, alcohol, aldehyde, or ketone group.

Other protecting groups include, but are not limited to Fmoc, t-butoxycarbonyl (t-BOC), 9-fluoreneacetyl group, 1-fluorenecarboxylic group, 9-florenecarboxylic group, 9-fluorenone-1-carboxylic group, benzyloxycarbonyl, xanthyl (Xan), trityl (Trt), 4-methyltrityl (Mtt), 4-methoxytrityl (Mmt), 4-methoxy-2,3,6-trimethyl-benzenesulphonyl (Mtr), Mesitylene-2-sulphonyl (Mts), 4,4-dimethoxybenzhydryl (Mbh), Tosyl (Tos), 2,2,5,7,8-pentamethyl chroman-6-sulphonyl (Pmc), 4-methylbenzyl (MeBzl), 4-methoxybenzyl (MeOBl), benzyloxy (BzlO), benzyl (Bzl), benzoyl (Bz), 3-nitro-2-pyridinesulphenyl (Npys), 1-(4,4-dimentyl-2,6-diaxocyclohexylidene)ethyl (Dde), 2,6-dichlorobenzyl (2,6-DiCl-Bzl), 2-chlorobenzyloxycarbonyl (2-Cl—Z), 2-bromobenzyloxycarbonyl (2-Br—Z), Benzyloxymethyl (Bom), cyclohexyloxy (cHxO), t-butoxymethyl (Bum), t-butoxy (tBuO), t-Butyl (tBu), Acetyl (Ac), and Trifluoroacetyl (TFA).

Protecting/blocking groups are well known to those of skill as are methods of coupling such groups to the appropriate residue(s) comprising the peptides of this invention (see, e.g., Greene et al., (1991) *Protective Groups in Organic Synthesis, 2nd ed.*, John Wiley & Sons, Inc., Somerset, N.J.). In an illustrative embodiment, for example, acetylation is accomplished during the synthesis when the peptide is on the resin using acetic anhydride. Amide protection can be achieved by the selection of a proper resin for the synthesis. For example, a rink amide resin can be used. After the completion of the synthesis, the semipermanent protecting groups on acidic bifunctional amino acids such as Asp and Glu and basic amino acid Lys, hydroxyl of Tyr are all simultaneously removed. The peptides released from such a resin using acidic treatment comes out with the n-terminal protected as acetyl and the carboxyl protected as $NH_2$ and with the simultaneous removal of all of the other protecting groups.

While amino acid sequences are disclosed herein, amino acid sequences comprising, one or more protecting groups, e.g., as described above (or any other commercially available protecting groups for amino acids used, e.g., in boc or fmoc peptide synthesis) are also contemplated.

Peptide Circularization.

In certain embodiments the peptides described herein (e.g., AMPs, compound AMPs, STAMPs, etc.) are circularized/cyclized to produce cyclic peptides. Cyclic peptides, as contemplated herein, include head/tail, head/side chain, tail/side chain, and side chain/side chain cyclized peptides. In addition, peptides contemplated herein include homodet, containing only peptide bonds, and heterodet containing in addition disulfide, ester, thioester-bonds, or other bonds.

The cyclic peptides can be prepared using virtually any art-known technique for the preparation of cyclic peptides. For example, the peptides can be prepared in linear or non-cyclized form using conventional solution or solid phase peptide syntheses and cyclized using standard chemistries. Preferably, the chemistry used to cyclize the peptide will be sufficiently mild so as to avoid substantially degrading the peptide. Suitable procedures for synthesizing the peptides described herein as well as suitable chemistries for cyclizing the peptides are well known in the art.

In various embodiments cyclization can be achieved via direct coupling of the N- and C-terminus to form a peptide (or other) bond, but can also occur via the amino acid side chains. Furthermore it can be based on the use of other functional groups, including but not limited to amino, hydroxy, sulfhydryl, halogen, sulfonyl, carboxy, and thiocarboxy. These groups can be located at the amino acid side chains or be attached to their N- or C-terminus.

Accordingly, it is to be understood that the chemical linkage used to covalently cyclize the peptides of the invention need not be an amide linkage. In many instances it may be desirable to modify the N- and C-termini of the linear or non-cyclized peptide so as to provide, for example, reactive groups that may be cyclized under mild reaction conditions. Such linkages include, by way of example and not limitation amide, ester, thioester, $CH_2$—NH, etc. Techniques and reagents for synthesizing peptides having modified termini and chemistries suitable for cyclizing such modified peptides are well-known in the art.

Alternatively, in instances where the ends of the peptide are conformationally or otherwise constrained so as to make cyclization difficult, it may be desirable to attach linkers to the N- and/or C-termini to facilitate peptide cyclization. Of course, it will be appreciated that such linkers will bear reactive groups capable of forming covalent bonds with the termini of the peptide. Suitable linkers and chemistries are well-known in the art and include those previously described.

Cyclic peptides and depsipeptides (heterodetic peptides that include ester (depside) bonds as part of their backbone) have been well characterized and show a wide spectrum of biological activity. The reduction in conformational freedom brought about by cyclization often results in higher receptor-binding affinities. Frequently in these cyclic compounds, extra conformational restrictions are also built in, such as the use of D- and N-alkylated-amino acids, α,β-dehydro amino acids or α,α-disubstituted amino acid residues.

Methods of forming disulfide linkages in peptides are well known to those of skill in the art (see, e.g., Eichler and Houghten (1997) *Protein Pept. Lett.* 4: 157-164).

Reference may also be made to Marlowe (1993) *Biorg. Med. Chem. Lett.* 3: 437-44 who describes peptide cyclization on TFA resin using trimethylsilyl (TMSE) ester as an orthogonal protecting group; Pallin and Tam (1995) *J. Chem. Soc. Chem. Comm.* 2021-2022) who describe the cyclization of unprotected peptides in aqueous solution by oxime formation; Algin et al. (1994) *Tetrahedron Lett.* 35: 9633-9636 who disclose solid-phase synthesis of head-to-tail cyclic peptides via lysine side-chain anchoring; Kates et al. (1993) *Tetrahedron Lett.* 34: 1549-1552 who describe the production of head-to-tail cyclic peptides by three-dimensional solid phase strategy; Tumelty et al. (1994) *J. Chem. Soc. Chem. Comm.* 1067-1068, who describe the synthesis of cyclic peptides from an immobilized activated intermediate, where activation of the immobilized peptide is carried out with N-protecting group intact and subsequent removal leading to cyclization; McMurray et al. (1994) *Peptide Res.* 7: 195-206) who disclose head-to-tail cyclization of peptides attached to insoluble supports by means of the side chains of aspartic and glutamic acid; Hruby et al. (1994) *Reactive Polymers* 22: 231-241) who teach an alternate method for cyclizing peptides via solid supports; and Schmidt and Langer (1997) *J. Peptide Res.* 49: 67-73, who disclose a method for synthesizing cyclotetrapeptides and cyclopentapeptides.

These methods of peptide cyclization are illustrative and non-limiting. Using the teaching provide herein, other cyclization methods will be available to one of skill in the art.

Joining Targeting Moieties to Effectors.

Chemical Conjugation.

Chimeric moieties are formed by joining one or more of the targeting moieties described herein to one or more effectors. In certain embodiments the targeting moieties are attached directly to the effector(s) via naturally occurring reactive groups or the targeting moiety and/or the effector(s) can be functionalized to provide such reactive groups.

In various embodiments the targeting moieties are attached to effector(s) via one or more linking agents. Thus, in various embodiments the targeting moieties and the effector(s) can be conjugated via a single linking agent or multiple linking agents. For example, the targeting moiety and the effector can be conjugated via a single multifunctional (e.g., bi-, tri-, or tetra-) linking agent or a pair of complementary linking agents. In another embodiment, the targeting moiety and the effector are conjugated via two, three, or more linking agents. Suitable linking agents include, but are not limited to, e.g., functional groups, affinity agents, stabilizing groups, and combinations thereof.

In certain embodiments the linking agent is or comprises a functional group. Functional groups include monofunctional linkers comprising a reactive group as well as multifunctional crosslinkers comprising two or more reactive groups capable of forming a bond with two or more different functional targets (e.g., labels, proteins, macromolecules, semiconductor nanocrystals, or substrate). In some preferred embodiments, the multifunctional crosslinkers are heterobifunctional crosslinkers comprising two or more different reactive groups.

Suitable reactive groups include, but are not limited to thiol (—SH), carboxylate (COOH), carboxyl (—COOH), carbonyl, amine (NH$_2$), hydroxyl (—OH), aldehyde (—CHO), alcohol (ROH), ketone (R$_2$CO), active hydrogen, ester, sulfhydryl (SH), phosphate (—PO$_3$), or photoreactive moieties. Amine reactive groups include, but are not limited to e.g., isothiocyanates, isocyanates, acyl azides, NHS esters, sulfonyl chlorides, aldehydes and glyoxals, epoxides and oxiranes, carbonates, arylating agents, imidoesters, carbodiimides, and anhydrides. Thiol-reactive groups include, but are not limited to e.g., haloacetyl and alkyl halide derivates, maleimides, aziridines, acryloyl derivatives, arylating agents, and thiol-disulfides exchange reagents. Carboxylate reactive groups include, but are not limited to e.g., diazoalkanes and diazoacetyl compounds, such as carbonyldiimidazoles and carbodiimides. Hydroxyl reactive groups include, but are not limited to e.g., epoxides and oxiranes, carbonyldiimidazole, oxidation with periodate, N,N'-disuccinimidyl carbonate or N-hydroxylsuccimidyl chloroformate, enzymatic oxidation, alkyl halogens, and isocyanates. Aldehyde and ketone reactive groups include, but are not limited to e.g., hydrazine derivatives for schiff base formation or reduction amination. Active hydrogen reactive groups include, but are not limited to e.g., diazonium derivatives for mannich condensation and iodination reactions. Photoreactive groups include, but are not limited to e.g., aryl azides and halogenated aryl azides, benzophenones, diazo compounds, and diazirine derivatives.

Other suitable reactive groups and classes of reactions useful in forming chimeric moieties include those that are well known in the art of bioconjugate chemistry. Currently favored classes of reactions available with reactive chelates are those which proceed under relatively mild conditions. These include, but are not limited to, nucleophilic substitutions (e.g., reactions of amines and alcohols with acyl halides, active esters), electrophilic substitutions (e.g., enamine reactions), and additions to carbon-carbon and carbon-heteroatom multiple bonds (e.g., Michael reaction, Diels-Alder addition). These and other useful reactions are discussed in, for example, March (1985) *Advanced Organic Chemistry*, 3rd Ed., John Wiley & Sons, New York, Hermanson (1996) *Bioconjugate Techniques*, Academic Press, San Diego; and Feeney et al. (1982) *Modification of Proteins; Advances in Chemistry Series*, Vol. 198, American Chemical Society, Washington, D.C.

In certain embodiments, the linking agent comprises a chelator. For example, the chelator comprising the molecule, DOTA (DOTA=1,4,7,10-tetrakis(carboxymethyl)-1,4,7,10-tetraazacyclododecane), can readily be labeled with a radiolabel, such as Gd$^{3+}$ and $^{64}$Cu, resulting in Gd$^{3+}$-DOTA and $^{64}$Cu-DOTA respectively, attached to the targeting moiety. Other suitable chelates are known to those of skill in the art, for example, 1,4,7-triazacyclononane-N,N',N''-triacetic acid (NOTA) derivatives being among the most well known (see, e.g., Lee et al. (1997) *Nucl Med. Biol.* 24: 2225-23019).

A "linker" or "linking agent" as used herein, is a molecule that is used to join two or more molecules. In certain embodiments the linker is typically capable of forming covalent bonds to both molecule(s) (e.g., the targeting moiety and the effector). Suitable linkers are well known to those of skill in the art and include, but are not limited to, straight or branched-chain carbon linkers, heterocyclic carbon linkers, or peptide linkers. In certain embodiments the linkers can be joined to the constituent amino acids through their side groups (e.g., through a disulfide linkage to cysteine). However, in certain embodiments, the linkers will be joined to the alpha carbon amino and carboxyl groups of the terminal amino acids.

A bifunctional linker having one functional group reactive with a group on one molecule (e.g., a targeting peptide), and another group reactive on the other molecule (e.g., an antimicrobial peptide), can be used to form the desired conjugate. Alternatively, derivatization can be performed to provide functional groups. Thus, for example, procedures for the generation of free sulfhydryl groups on peptides are also known (See U.S. Pat. No. 4,659,839).

In certain embodiments the linking agent is a heterobifunctional crosslinker comprising two or more different reactive groups that form a heterocyclic ring that can interact with a peptide. For example, a heterobifunctional crosslinker such as cysteine may comprise an amine reactive group and a thiol-reactive group can interact with an aldehyde on a derivatized peptide. Additional combinations of reactive groups suitable for heterobifunctional crosslinkers include, for example, amine- and sulfhydryl reactive groups; carbonyl and sulfhydryl reactive groups; amine and photoreactive groups; sulfhydryl and photoreactive groups; carbonyl and photoreactive groups; carboxylate and photoreactive groups; and arginine and photoreactive groups. In one embodiment, the heterobifunctional crosslinker is SMCC.

Many procedures and linker molecules for attachment of various molecules to peptides or proteins are known (see, e.g., European Patent Application No. 188,256; U.S. Pat. Nos. 4,671,958, 4,659,839, 4,414,148, 4,699,784; 4,680,338; 4,569,789; and 4,589,071; and Borlinghaus et al. (1987) *Cancer Res.* 47: 4071-4075). Illustrative linking protocols are provided herein in Examples 2 and 3.

Fusion Proteins.

In certain embodiments where the targeting moiety and effector are both peptides or both comprise peptides, the chimeric moiety can be chemically synthesized or recombinantly expressed as a fusion protein (i.e., a chimeric fusion protein).

In certain embodiments the chimeric fusion proteins are synthesized using recombinant DNA methodology. Generally this involves creating a DNA sequence that encodes the fusion protein, placing the DNA in an expression cassette under the control of a particular promoter, expressing the protein in a host, isolating the expressed protein and, if required, renaturing the protein.

DNA encoding the fusion proteins can be prepared by any suitable method, including, for example, cloning and restriction of appropriate sequences or direct chemical synthesis by methods such as the phosphotriester method of Narang et al. (1979) *Meth. Enzymol.* 68: 90-99; the phosphodiester method of Brown et al. (1979) *Meth. Enzymol.* 68: 109-151; the diethylphosphoramidite method of Beaucage et al. (1981) *Tetra. Lett.,* 22: 1859-1862; and the solid support method of U.S. Pat. No. 4,458,066.

Chemical synthesis produces a single stranded oligonucleotide. This can be converted into double stranded DNA by hybridization with a complementary sequence or by polymerization with a DNA polymerase using the single strand as a template. One of skill would recognize that while chemical synthesis of DNA is limited to sequences of about 100 bases, longer sequences can be obtained by the ligation of shorter sequences.

Alternatively, subsequences can be cloned and the appropriate subsequences cleaved using appropriate restriction enzymes. The fragments can then be ligated to produce the desired DNA sequence.

In certain embodiments, DNA encoding fusion proteins of the present invention may be cloned using DNA amplification methods such as polymerase chain reaction (PCR). Thus, for example, the nucleic acid encoding a targeting antibody, a targeting peptide, and the like is PCR amplified, using a sense primer containing the restriction site for NdeI and an antisense primer containing the restriction site for HindIII. This produces a nucleic acid encoding the targeting sequence and having terminal restriction sites. Similarly an effector and/or effector/linker/spacer can be provided having complementary restriction sites. Ligation of sequences and insertion into a vector produces a vector encoding the fusion protein.

While the targeting moieties and effector(s) can be directly joined together, one of skill will appreciate that they can be separated by a peptide spacer/linker consisting of one or more amino acids. Generally the spacer will have no specific biological activity other than to join the proteins or to preserve some minimum distance or other spatial relationship between them. However, the constituent amino acids of the spacer may be selected to influence some property of the molecule such as the folding, net charge, or hydrophobicity.

The nucleic acid sequences encoding the fusion proteins can be expressed in a variety of host cells, including *E. coli*, other bacterial hosts, yeast, and various higher eukaryotic cells such as the COS, CHO and HeLa cells lines and myeloma cell lines. The recombinant protein gene will be operably linked to appropriate expression control sequences for each host. For *E. coli* this includes a promoter such as the T7, trp, or lambda promoters, a ribosome binding site and preferably a transcription termination signal. For eukaryotic cells, the control sequences will include a promoter and preferably an enhancer derived from immunoglobulin genes, SV40, cytomegalovirus, etc., and a polyadenylation sequence, and may include splice donor and acceptor sequences.

The plasmids can be transferred into the chosen host cell by well-known methods such as calcium chloride transformation for *E. coli* and calcium phosphate treatment or electroporation for mammalian cells. Cells transformed by the plasmids can be selected by resistance to antibiotics conferred by genes contained on the plasmids, such as the amp, gpt, neo and hyg genes.

Once expressed, the recombinant fusion proteins can be purified according to standard procedures of the art, including ammonium sulfate precipitation, affinity columns, column chromatography, gel electrophoresis and the like (see, generally, R. Scopes (1982) *Protein Purification*, Springer-Verlag, N.Y.; Deutscher (1990) *Methods in Enzymology Vol. 182: Guide to Protein Purification.*, Academic Press, Inc. N.Y.). Substantially pure compositions of at least about 90 to 95% homogeneity are preferred, and 98 to 99% or more homogeneity are most preferred for pharmaceutical uses. Once purified, partially or to homogeneity as desired, the polypeptides may then be used therapeutically.

One of skill in the art would recognize that after chemical synthesis, biological expression, or purification, the fusion protein may possess a conformation substantially different than the native conformations of the constituent polypeptides. In this case, it may be necessary to denature and reduce the polypeptide and then to cause the polypeptide to re-fold into the preferred conformation. Methods of reducing and denaturing proteins and inducing re-folding are well known to those of skill in the art (See, Debinski et al. (1993) *J. Biol. Chem.,* 268: 14065-14070; Kreitman and Pastan (1993) *Bioconjug. Chem.,* 4: 581-585; and Buchner, et al. (1992) *Anal. Biochem.,* 205: 263-270).

One of skill would recognize that modifications can be made to the fusion proteins without diminishing their biological activity. Some modifications may be made to facilitate the cloning, expression, or incorporation of the targeting molecule into a fusion protein. Such modifications are well known to those of skill in the art and include, for example, a methionine added at the amino terminus to provide an initiation site, or additional amino acids placed on either terminus to create conveniently located restriction sites or termination codons.

As indicated above, in various embodiments a peptide linker/spacer is used to join the one or more targeting moieties to one or more effector(s). In various embodiments the peptide linker is relatively short, typically less than about 10 amino acids, preferably less than about 8 amino acids and more preferably about 3 to about 5 amino acids. Suitable illustrative linkers include, but are not limited to PSGSP ((SEQ ID NO:1932), ASASA (SEQ ID NO: 1933), or GGG (SEQ ID NO: 1934). In certain embodiments longer linkers such as (GGGGS)$_3$ (SEQ ID NO:1935) can be used. Illustrative peptide linkers and other linkers are shown in Table 11.

TABLE 11

Illustrative peptide and non-peptide linkers.

| Linker | SEQ ID NO: |
|---|---|
| AAA | 1936 |
| GGG | 1937 |
| SGG | 1938 |
| GGSGGS | 1939 |
| SAT | 1940 |
| PYP | 1941 |
| PSPSP | 1942 |
| ASA | 1943 |
| ASASA | 1944 |
| PSPSP | 1945 |
| KKKK | 1946 |
| RRRR | 1947 |
| (Gly$_4$Ser)$_3$ | 1948 |
| GGGG | 1954 |
| GGGGS | 1955 |
| GGGGS GGGGS | 1956 |
| GGGGS GGGGS GGGGS GGGGS | 1957 |
| GGGGS GGGGS GGGGS GGGGS GGGGS | 1958 |
| GGGGS GGGGS GGGGS GGGGS GGGGS GGGGS | 1959 |

2-nitrobenzene or 0-nitrobenzyl

Nitropyridyl disulfide

Dioleoylphosphatidylethanolamine (DOPE)

S-acetylmercaptosuccinic acid 1,4,7,10-tetraazacyclododecane-1,4,7,10-tetracetic acid (DOTA)

β-glucuronide and β-glucuronide variants

Poly(alkylacrylic acid)

Benzene-based linkers (for example: 2,5-Bis(hexyloxy)-1,4-bis[2,5-bis(hexyloxy)-4-formyl-phenylenevinylene]benzene) and like molecules Disulfide linkages Poly(amidoamine) or like dendrimers linking multiple target and killing peptides in one molecule Carbon nanotubes Hydrazone and hydrazone variant linkers PEG of any chain length Succinate, formate, acetate butyrate, other like organic acids Aldols, alcohols, or enols Peroxides alkane or alkene groups of any chain length One or more porphyrin or dye molecules containing free amide and TABLE 11-continued Illustrative peptide and non-peptide linkers.

| Linker | SEQ ID NO: |
|---|---|
| carboxylic acid groups | |
| One or more DNA or RNA nucleotides, including polyamine and polycarboxyl-containing variants | |
| Inulin, sucrose, glucose, or other single, di or polysaccharides | |
| Linoleic acid or other polyunsaturated fatty acids | |
| Variants of any of the above linkers containing halogen or thiol groups | |

(all amino-acid-based linkers could be L, D, combinations of L and D forms, β-form, PEG backbone, and the like)

Multiple Targeting Moieties and/or Effectors.

As indicated above, in certain embodiments, the chimeric moieties described herein comprise multiple targeting moieties attached to a single effector or multiple effectors attached to a single targeting moiety, or multiple targeting moieties attached to multiple effectors.

Where the chimeric construct is a fusion protein this is easily accomplished by providing multiple domains that are targeting domains attached to one or more effector domains. FIG. 12 schematically illustrates a few, but not all, configurations. In various embodiments the multiple targeting domains and/or multiple effector domains can be attached to each other directly or can be separated by linkers (e.g., amino acid or peptide linkers as described above).

When the chimeric construct is a chemical conjugate linear or branched configurations (e.g., as illustrated in FIG. 12) are readily produced by using branched or multifunctional linkers and/or a plurality of different linkers.

III. Administration and Formulations.

Pharmaceutical Formulations.

In certain embodiments, the antimicrobial peptides and/or the chimeric constructs (e.g., targeting moieties attached to antimicrobial peptide(s), targeting moieties attached to detectable label(s), etc.) are administered to a mammal in need thereof, to a cell, to a tissue, to a composition (e.g., a food, etc.). In various embodiments the compositions can be administered to detect and/or locate, and/or quantify the presence of particular microorganisms, microorganism populations, biofilms comprising particular microorganisms, and the like. In various embodiments the compositions can be administered to inhibit particular microorganisms, microorganism populations, biofilms comprising particular microorganisms, and the like.

These active agents (antimicrobial peptides and/or chimeric moieties) can be administered in the "native" form or, if desired, in the form of salts, esters, amides, prodrugs, derivatives, and the like, provided the salt, ester, amide, prodrug or derivative is suitable pharmacologically, i.e., effective in the present method(s). Salts, esters, amides, prodrugs and other derivatives of the active agents can be prepared using standard procedures known to those skilled in the art of synthetic organic chemistry and described, for example, by March (1992) *Advanced Organic Chemistry; Reactions, Mechanisms and Structure,* 4th Ed. N.Y. Wiley-Interscience.

Methods of formulating such derivatives are known to those of skill in the art. For example, the disulfide salts of a number of delivery agents are described in PCT Publication WO 00/059863 which is incorporated herein by reference. Similarly, acid salts of therapeutic peptides, peptoids, or other mimetics, and can be prepared from the free base using conventional methodology that typically involves reaction with a suitable acid. Generally, the base form of the drug is dissolved in a polar organic solvent such as methanol or ethanol and the acid is added thereto. The resulting salt either precipitates or can be brought out of solution by addition of a less polar solvent. Suitable acids for preparing acid addition salts include, but are not limited to both organic acids, e.g., acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluenesulfonic acid, salicylic acid, and the like, as well as inorganic acids, e.g., hydrochloric acid, hydrobromic acid, sulfuric acid, nitric acid, phosphoric acid, and the like. An acid addition salt can be reconverted to the free base by treatment with a suitable base. Certain particularly preferred acid addition salts of the active agents herein include halide salts, such as may be prepared using hydrochloric or hydrobromic acids. Conversely, preparation of basic salts of the active agents of this invention are prepared in a similar manner using a pharmaceutically acceptable base such as sodium hydroxide, potassium hydroxide, ammonium hydroxide, calcium hydroxide, trimethylamine, or the like. In certain embodiments basic salts include alkali metal salts, e.g., the sodium salt, and copper salts.

For the preparation of salt forms of basic drugs, the pKa of the counterion is preferably at least about 2 pH lower than the pKa of the drug. Similarly, for the preparation of salt forms of acidic drugs, the pKa of the counterion is preferably at least about 2 pH higher than the pKa of the drug. This permits the counterion to bring the solution's pH to a level lower than the pHmax to reach the salt plateau, at which the solubility of salt prevails over the solubility of free acid or base. The generalized rule of difference in pKa units of the ionizable group in the active pharmaceutical ingredient (API) and in the acid or base is meant to make the proton transfer energetically favorable. When the pKa of the API and counterion are not significantly different, a solid complex may form but may rapidly disproportionate (i.e., break down into the individual entities of drug and counterion) in an aqueous environment.

Preferably, the counterion is a pharmaceutically acceptable counterion. Suitable anionic salt forms include, but are not limited to acetate, benzoate, benzylate, bitartrate, bromide, carbonate, chloride, citrate, edetate, edisylate, estolate, fumarate, gluceptate, gluconate, hydrobromide, hydrochloride, iodide, lactate, lactobionate, malate, maleate, mandelate, mesylate, methyl bromide, methyl sulfate, mucate, napsylate, nitrate, pamoate (embonate), phosphate and diphosphate, salicylate and disalicylate, stearate, succinate, sulfate, tartrate, tosylate, triethiodide, valerate, and the like, while suitable cationic salt forms include, but are not limited to aluminum, benzathine, calcium, ethylene diamine, lysine, magnesium, meglumine, potassium, procaine, sodium, tromethamine, zinc, and the like.

In various embodiments preparation of esters typically involves functionalization of hydroxyl and/or carboxyl groups that are present within the molecular structure of the active agent. In certain embodiments, the esters are typically acyl-substituted derivatives of free alcohol groups, i.e., moieties that are derived from carboxylic acids of the formula RCOOH where R is alkyl, and preferably is lower alkyl. Esters can be reconverted to the free acids, if desired, by using conventional hydrogenolysis or hydrolysis procedures.

Amides can also be prepared using techniques known to those skilled in the art or described in the pertinent literature. For example, amides may be prepared from esters, using suitable amine reactants, or they may be prepared from an anhydride or an acid chloride by reaction with ammonia or a lower alkyl amine.

In various embodiments, the active agents identified herein are useful for parenteral, topical, oral, nasal (or otherwise inhaled), rectal, or local administration, such as by aerosol or transdermally, for detection and/or quantification, and or localization, and/or prophylactic and/or therapeutic treatment of infection (e.g., microbial infection). The compositions can be administered in a variety of unit dosage forms depending upon the method of administration. Suitable unit dosage forms, include, but are not limited to powders, tablets, pills, capsules, lozenges, suppositories, patches, nasal sprays, injectables, implantable sustained-release formulations, lipid complexes, etc.

The active agents (e.g., antimicrobial peptides and/or chimeric constructs) described herein can also be combined with a pharmaceutically acceptable carrier (excipient) to form a pharmacological composition. Pharmaceutically acceptable carriers can contain one or more physiologically acceptable compound(s) that act, for example, to stabilize the composition or to increase or decrease the absorption of the active agent(s). Physiologically acceptable compounds can include, for example, carbohydrates, such as glucose, sucrose, or dextrans, antioxidants, such as ascorbic acid or glutathione, chelating agents, low molecular weight proteins, protection and uptake enhancers such as lipids, compositions that reduce the clearance or hydrolysis of the active agents, or excipients or other stabilizers and/or buffers.

Pharmaceutically acceptable carriers can contain one or more physiologically acceptable compound(s) that act, for example, to stabilize the composition or to increase or decrease the absorption of the active agent(s). Physiologically acceptable compounds can include, for example, carbohydrates, such as glucose, sucrose, or dextrans, antioxidants, such as ascorbic acid or glutathione, chelating agents, low molecular weight proteins, protection and uptake enhancers such as lipids, compositions that reduce the clearance or hydrolysis of the active agents, or excipients or other stabilizers and/or buffers.

Other physiologically acceptable compounds, particularly of use in the preparation of tablets, capsules, gel caps, and the like include, but are not limited to binders, diluent/fillers, disentegrants, lubricants, suspending agents, and the like.

In certain embodiments, to manufacture an oral dosage form (e.g., a tablet), an excipient (e.g., lactose, sucrose, starch, mannitol, etc.), an optional disintegrator (e.g. calcium carbonate, carboxymethylcellulose calcium, sodium starch glycollate, crospovidone etc.), a binder (e.g. alpha-starch, gum arabic, microcrystalline cellulose, carboxymethylcellulose, polyvinylpyrrolidone, hydroxypropylcellulose, cyclodextrin, etc.), and an optional lubricant (e.g., talc, magnesium stearate, polyethylene glycol 6000, etc.), for instance, are added to the active component or components (e.g., active) and the resulting composition is compressed. Where necessary the compressed product is coated, e.g., known methods for masking the taste or for enteric dissolution or sustained release. Suitable coating materials include, but are not limited to ethyl-cellulose, hydroxymethylcellulose, polyoxyethylene glycol, cellulose acetate phthalate, hydroxypropylmethylcellulose phthalate, and Eudragit (Rohm & Haas, Germany; methacrylic-acrylic copolymer).

Other physiologically acceptable compounds include wetting agents, emulsifying agents, dispersing agents or preservatives that are particularly useful for preventing the growth or action of microorganisms. Various preservatives are well known and include, for example, phenol and ascorbic acid. One skilled in the art would appreciate that the choice of pharmaceutically acceptable carrier(s), including a physiologically acceptable compound depends, for example, on the route of administration of the active agent(s) and on the particular physio-chemical characteristics of the active agent(s).

In certain embodiments the excipients are sterile and generally free of undesirable matter. These compositions can be sterilized by conventional, well-known sterilization techniques. For various oral dosage form excipients such as tablets and capsules sterility is not required. The USP/NF standard is usually sufficient.

In certain therapeutic applications, the compositions of this invention are administered, e.g., topically administered or administered to the oral or nasal cavity, to a patient suffering from infection or at risk for infection or prophylactically to prevent dental caries or other pathologies of the teeth or oral mucosa characterized by microbial infection in an amount sufficient to prevent and/or cure and/or at least partially prevent or arrest the disease and/or its complications. An amount adequate to accomplish this is defined as a "therapeutically effective dose." Amounts effective for this use will depend upon the severity of the disease and the general state of the patient's health. Single or multiple administrations of the compositions may be administered depending on the dosage and frequency as required and tolerated by the patient. In any event, the composition should provide a sufficient quantity of the active agents of the formulations of this invention to effectively treat (ameliorate one or more symptoms in) the patient.

The concentration of active agent(s) can vary widely, and will be selected primarily based on activity of the active ingredient(s), body weight and the like in accordance with the particular mode of administration selected and the patient's needs. Concentrations, however, will typically be selected to provide dosages ranging from about 0.1 or 1 mg/kg/day to about 50 mg/kg/day and sometimes higher. Typical dosages range from about 3 mg/kg/day to about 3.5 mg/kg/day, preferably from about 3.5 mg/kg/day to about 7.2 mg/kg/day, more preferably from about 7.2 mg/kg/day to about 11.0 mg/kg/day, and most preferably from about 11.0 mg/kg/day to about 15.0 mg/kg/day. In certain preferred embodiments, dosages range from about 10 mg/kg/day to about 50 mg/kg/day. In certain embodiments, dosages range from about 20 mg to about 50 mg given orally twice daily. It will be appreciated that such dosages may be varied to optimize a therapeutic and/or prophylactic regimen in a particular subject or group of subjects.

In certain embodiments, the active agents of this invention are administered to the oral cavity. This is readily accomplished by the use of lozenges, aerosol sprays, mouthwash, coated swabs, and the like.

In certain embodiments, the active agent(s) of this invention are administered topically, e.g., to the skin surface, to a topical lesion or wound, to a surgical site, and the like.

In certain embodiments the active agents of this invention are administered systemically (e.g., orally, or as an injectable) in accordance with standard methods well known to those of skill in the art. In other preferred embodiments, the agents, can also be delivered through the skin using conventional transdermal drug delivery systems, i.e., transdermal "patches" wherein the active agent(s) are typically contained within a laminated structure that serves as a drug delivery device to be affixed to the skin. In such a structure, the drug composition is typically contained in a layer, or "reservoir," underlying an upper backing layer. It will be appreciated that the term "reservoir" in this context refers to a quantity of "active ingredient(s)" that is ultimately available for delivery to the surface of the skin. Thus, for example, the "reservoir" may include the active ingredient(s) in an adhesive on a backing layer of the patch, or in any of a variety of different matrix formulations known to those of skill in the art. The patch may contain a single reservoir, or it may contain multiple reservoirs.

In one embodiment, the reservoir comprises a polymeric matrix of a pharmaceutically acceptable contact adhesive material that serves to affix the system to the skin during drug delivery. Examples of suitable skin contact adhesive materials include, but are not limited to, polyethylenes, polysiloxanes, polyisobutylenes, polyacrylates, polyurethanes, and the like. Alternatively, the drug-containing reservoir and skin contact adhesive are present as separate and distinct layers, with the adhesive underlying the reservoir which, in this case, may be either a polymeric matrix as described above, or it may be a liquid or hydrogel reservoir, or may take some other form. The backing layer in these laminates, which serves as the upper surface of the device, preferably functions as a primary structural element of the "patch" and provides the device with much of its flexibility. The material selected for the backing layer is preferably substantially impermeable to the active agent(s) and any other materials that are present.

Other formulations for topical delivery include, but are not limited to, ointments, gels, sprays, fluids, and creams. Ointments are semisolid preparations that are typically based on petrolatum or other petroleum derivatives. Creams containing the selected active agent are typically viscous liquid or semisolid emulsions, often either oil-in-water or water-in-oil. Cream bases are typically water-washable, and contain an oil phase, an emulsifier and an aqueous phase. The oil phase, also sometimes called the "internal" phase, is generally comprised of petrolatum and a fatty alcohol such as cetyl or stearyl alcohol; the aqueous phase usually, although not necessarily, exceeds the oil phase in volume, and generally contains a humectant. The emulsifier in a cream formulation is generally a nonionic, anionic, cationic or amphoteric surfactant. The specific ointment or cream base to be used, as will be appreciated by those skilled in the art, is one that will provide for optimum drug delivery. As with other carriers or vehicles, an ointment base should be inert, stable, nonirritating and non-sensitizing.

As indicated above, various buccal, and sublingual formulations are also contemplated.

In certain embodiments, one or more active agents of the present invention can be provided as a "concentrate", e.g., in a storage container (e.g., in a premeasured volume) ready for dilution, or in a soluble capsule ready for addition to a volume of water, alcohol, hydrogen peroxide, or other diluent.

While the invention is described with respect to use in humans, it is also suitable for animal, e.g., veterinary use. Thus certain preferred organisms include, but are not limited to humans, non-human primates, canines, equines, felines, porcines, ungulates, largomorphs, and the like.

The foregoing formulations and administration methods are intended to be illustrative and not limiting. It will be appreciated that, using the teaching provided herein, other suitable formulations and modes of administration can be readily devised.

Home Health Care Product Formulations.

In certain embodiments, one or more of the antimicrobial peptides (AMPs) and/or chimeric moieties described herein are incorporated into healthcare formulations, e.g., for home use. Such formulations include, but are not limited to toothpaste, mouthwash, tooth whitening strips or solutions, contact lens storage, wetting, or cleaning solutions, dental floss, toothpicks, toothbrush bristles, oral sprays, oral lozenges, nasal sprays, aerosolizers for oral and/or nasal application, wound dressings (e.g., bandages), and the like.

The formulation of such health products is well known to those of skill, and the antimicrobial peptides and/or chimeric constructs are simply added to such formulations in an effective dose (e.g., a prophylactic dose to inhibit dental carie formation, etc.).

For example, toothpaste formulations are well known to those of skill in the art. Typically such formulations are mixtures of abrasives and surfactants; anticaries agents, such as fluoride; tartar control ingredients, such as tetrasodium pyrophosphate and methyl vinyl ether/maleic anhydride copolymer; pH buffers; humectants, to prevent dry-out and increase the pleasant mouth feel; and binders, to provide consistency and shape (see, e.g., Table 12). Binders keep the solid phase properly suspended in the liquid phase to prevent separation of the liquid phase out of the toothpaste. They also provide body to the dentifrice, especially after extrusion from the tube onto the toothbrush.

TABLE 12

Typical components of toothpaste.

| Ingredients | Wt % |
| --- | --- |
| Humectants | 40-70 |
| Water | 0-50 |
| Buffers/salts/tartar control | 0.5-10 |
| Organic thickeners (gums) | 0.4-2 |
| Inorganic thickeners | 0-12 |
| Abrasives | 10-50 |
| Actives (e.g., triclosan) | 0.2-1.5 |
| Surfactants | 0.5-2 |
| Flavor and sweetener | 0.8-1.5 |

Fluoride sources provide 1000-15000 ppm fluorine.

Table 13 lists typical ingredients used in formulations; the final combination will depend on factors such as ingredient compatibility and cost, local customs, and desired benefits and quality to be delivered in the product. It will be recognized that one or more antimicrobial peptides and/or chimeric constructs described herein can simply be added to such formulations or used in place of one or more of the other ingredients.

TABLE 13

List of typical ingredients

| Gums | Inorganic Thickeners | Abrasives | Surfactants | Humectants | Tartar Control Ingredient |
|---|---|---|---|---|---|
| Sodium carboxymethyl cellulose | Silica thickeners | Hydrated silica | Sodium lauryl sulfate | Glycerine | Tetrasodium pyrophosphate |
| Cellulose ethers | Sodium aluminum silicates | Dicalcium phosphate digydrate | Sodium N-lauryl sarcosinate | Sorbitol | Gantrez S-70 |
| Xanthan Gum | Clays | Calcium carbonate | Pluronics | Propylene glycol | Sodium tri-polyphosphate |
| Carrageenans | | Sodium bicarbonate | | Xylitol | |
| Sodium alginate | | Calcium pyrophosphate | Sodium lauryl sulfoacetate | Polyethylene glycol | |
| Carbopols | | Alumina | | | |

One illustrative formulation described in U.S. Pat. No. 6,113,887 comprises (1) a water-soluble bactericide selected from the group consisting of pyridinium compounds, quaternary ammonium compounds and biguanide compounds in an amount of 0.001% to 5.0% by weight, based on the total weight of the composition; (2) a cationically-modified hydroxyethylcellulose having an average molecular weight of 1,000,000 or higher in the hydroxyethylcellulose portion thereof and having a cationization degree of 0.05 to 0.5 mol/glucose in an amount of 0.5% to 5.0% by weight, based on the total weight of the composition; (3) a surfactant selected from the group consisting of polyoxyethylene polyoxypropylene block copolymers and alkylolamide compounds in an amount of 0.5% to 13% by weight, based on the total weight of the composition; and (4) a polishing agent of the non-silica type in an amount of 5% to 50% by weight, based on the total weight of the composition. In certain embodiments, the antimicrobial peptide(s) and/or chimeric construct(s) described herein can be used in place of the bactericide or in combination with the bactericide.

Similarly, mouthwash formulations are also well known to those of skill in the art. Thus, for example, mouthwashes containing sodium fluoride are disclosed in U.S. Pat. Nos. 2,913,373, 3,975,514, and 4,548,809, and in US Patent Publications US 2003/0124068 A1, US 2007/0154410 A1, and the like. Mouthwashes containing various alkali metal compounds are also known: sodium benzoate (WO 9409752); alkali metal hypohalite (US 20020114851A1); chlorine dioxide (CN 1222345); alkali metal phosphate (US 2001/0002252 A1, US 2003/0007937 A1); hydrogen sulfate/carbonate (JP 8113519); cetylpyridium chloride (CPC) (see, e.g., U.S. Pat. No. 6,117,417, U.S. Pat. No. 5,948,390, and JP 2004051511). Mouthwashes containing higher alcohol (see, e.g., US 2002/0064505 A1, US 2003/0175216 A1); hydrogen peroxide (see, e.g., CN 1385145); $CO_2$ gas bubbles (see, e.g., JP 1275521 and JP 2157215) are also known. In certain embodiments, these and other mouthwash formulations can further comprise one or more of the AMPs or compound AMPs of this invention.

Contact lens storage, wetting, or cleaning solutions, dental floss, toothpicks, toothbrush bristles, oral sprays, oral lozenges, nasal sprays, and aerosolizers for oral and/or nasal application, and the like are also well known to those of skill in the art and can readily be adapted to incorporate one or more antimicrobial peptide(s) and/or chimeric construct(s) described herein.

The foregoing home healthcare formulations and/or devices are meant to be illustrative and not limiting. Using teaching provided herein, the antimicrobial peptide(s) and/or chimeric construct(s) described herein can readily be incorporated into other products.

IV. Kits.

In another embodiment this invention provides kits for the inhibition of an infection and/or for the treatment and/or prevention of dental caries in a mammal. The kits typically comprise a container containing one or more of the active agents (i.e., the antimicrobial peptide(s) and/or chimeric construct(s)) described herein. In certain embodiments the active agent(s) can be provided in a unit dosage formulation (e.g., suppository, tablet, caplet, patch, etc.) and/or may be optionally combined with one or more pharmaceutically acceptable excipients.

In certain embodiments the kits comprise one or more of the home healthcare product formulations described herein (e.g., toothpaste, mouthwash, tooth whitening strips or solutions, contact lens storage, wetting, or cleaning solutions, dental floss, toothpicks, toothbrush bristles, oral sprays, oral lozenges, nasal sprays, aerosolizers for oral and/or nasal application, and the like).

In certain embodiments kits are provided for detecting and/or locating and/or quantifying certain target microorganisms and/or cells or tissues comprising certain target microorganisms, and/or prosthesis bearing certain target microorganisms, and/or biofilms comprising certain target microorganisms. In various embodiments these kits typically comprise a chimeric moiety comprising a targeting moiety and a detectable label as described herein and/or a targeting moiety attached to an affinity tag for use in a pretargeting strategy as described herein.

In addition, the kits optionally include labeling and/or instructional materials providing directions (i.e., protocols) for the practice of the methods or use of the "therapeutics" or "prophylactics" or detection reagents of this invention. Certain instructional materials describe the use of one or more active agent(s) of this invention to therapeutically or prophylactically to inhibit or prevent infection and/or to inhibit the formation of dental caries. The instructional materials may also, optionally, teach preferred dosages/therapeutic regiment, counter indications and the like.

While the instructional materials typically comprise written or printed materials they are not limited to such. Any medium capable of storing such instructions and communicating them to an end user is contemplated by this invention.

Such media include, but are not limited to electronic storage media (e.g., magnetic discs, tapes, cartridges, chips), optical media (e.g., CD ROM), and the like. Such media may include addresses to internet sites that provide such instructional materials.

EXAMPLES

The following examples are offered to illustrate, but not to limit the claimed invention.

Example 1

Design and Activity of a "Dual-Targeted" Antimicrobial Peptide

Numerous reports have indicated the important role of human normal flora in the prevention of microbial pathogenesis and disease. Evidence suggests that infections at mucosal surfaces result from the outgrowth of subpopulations or clusters within a microbial community, and are not linked to one pathogenic organism alone. In order to preserve the protective normal flora while treating the majority of infective bacteria in the community, a tunable therapeutic is necessary that can discriminate between benign bystanders and multiple pathogenic organisms. Here we describe the proof-of-principle for such a multi-targeted antimicrobial: a multiple-headed specifically-targeted antimicrobial peptide (MH-STAMP). The completed MH-STAMP, M8(KH)-20, displays specific activity against targeted organisms in vitro (*Pseudomonas aeruginosa* and *Streptococcus mutans*) and can remove both species from a mixed planktonic culture with little impact against untargeted bacteria. These results demonstrate that a functional, dual-targeted molecule can be constructed from wide-spectrum antimicrobial peptide precursor.

Introduction

For nearly 30 years antimicrobial peptides (AMPs) have been rigorously investigated as alternatives to small molecule antibiotics and potential solutions to the growing crisis of antibiotic resistant bacterial infections [1, 2]. Numerous reports have characterized potential AMPs from natural sources, and a great body of work has been carried out designing "tailor-made" AMPs due to the approachable nature of solid-phase peptide synthesis (SPPS) [3, 4]. Several examples of the latter have shown remarkable activities in vitro against fungi, Gram-positive and Gram-negative bacteria, as well as some enveloped viruses [5].

Unlike small molecule antibiotics that may lose activity when their basic structures are modified even incrementally, peptides are a convenient canvas for molecular alteration. AMPs can be optimized through the incorporation of more or less hydrophobic or charged amino acids, which has been shown to affect selectivity for Gram-positive, Gram-negative or fungal membranes [6, 7]. Additionally, lysine residues can be utilized to improve AMP activity per µM. In this approach, multiple AMP chains can be attached to a single peptide scaffold through branching from lysine epsilon-amines [8, 9]. AMP activity can be specifically tuned through the attachment of a targeting peptide region, as described for a novel class of molecules, the specifically-targeted antimicrobial peptides, or STAMPs [10, 11]. These chimeric molecules can consist of functionally independent targeting and killing moieties within a linear peptide sequence. A pathogenic bacterium recognized (i.e. bound) by the targeting peptide can be eliminated from a multi-species community with little impact to bystander normal flora. As an extension of this concept, we hypothesized that a STAMP could be constructed with multiple targeting peptide "heads" attached to a single AMP by utilizing a central lysine residue branch point. Potentially, targeting "heads" could be specific for the same pathogen, or have different binding profiles. Utilizing the former approach, microbial resistance evolution linked to a targeting peptide could be inhibited or reduced, as no single microbial population would have the genetic diversity necessary to mutate multiple discrete targeting peptide receptors in one cell [12].

Multi-headed STAMP (MH-STAMP) molecules with differing bacterial targets may have appeal in treating polymicrobial infections, or where it may be advantageous to remove a cluster of biofilm constituents without utilizing several distinct molecules; for example in the simultaneously treatment of dental caries and periodontitis, or in the eradication of the *Propionibacteria* spp. and *Staphylococcus* spp. involved in acne and skin infections, respectively.

In this example, we present the proof-of-principle design, synthesis and in vitro activity of such a MH-STAMP, M8(KH)-20. Previously, we identified two functional STAMP targeting domains, one with specific recognition of the cariogenic pathogen *S. mutans* [10], and the other with *Pseudomonas* spp.-level selectivity [13]. Conjoined to a normally wide-spectrum linear AMP, we observed antimicrobial effects directed specifically to *P. aeruginosa* and *S. mutans* in vitro. Additionally, treatment of mixed bacterial communities with the multi-headed MH-STAMP resulted in the specific eradication of the target organisms with little impact on bystander population levels.

Materials and Methods

Bacterial Strains and Growth Conditions

*P. aeruginosa* ATCC 15692, *Klebsiella pneumoniae* KAY 2026 [14], *Escherichia coli* DH5α (pFW5, spectinomycin resistance) [15], *Staphylococcus aureus* Newmann [16], and *Staphylococcus epidermidis* ATCC 35984 were cultivated under aerobic conditions at 37° C. with vigorous shaking. Aerobic Gram-negative organisms were grown in Lauri-Bertaini (LB) broth and Gram-positive bacteria in Brain-heart infusion (BHI) broth. *Streptococcus mutans* JM11 (spectinomycin resistant, UA140 background) was grown in Todd-Hewitt (TH) broth under anaerobic conditions (80% N2, 15% $CO_2$, 5% H2) at 37° C. [17]. All bacteria were grown overnight to an OD600 of 0.8-1.0 prior to appropriate dilution and antimicrobial testing.

Synthesis of Multi-Head STAMP Peptides

Conventional solid-phase peptide synthesis (SPPS) methodologies were utilized for the construction of all peptides shown in FIG. 13 (Symphony Synthesizer, PTI, Tucson, Ariz.). Chemicals, amino acids, and synthesis resins were purchased from Anaspec (San Jose, Calif.). BD2.20 (FIRK-FLKKWLL (SEQ ID NO:1949), amidated C-terminus, mw 1491.92), an antimicrobial peptide developed in our laboratory with robust antimicrobial activity against a number of bacterial species (Table 14), served as the root sequence to which differing targeting peptides were attached: Firstly, BD2.20 was synthesized by SPPS (Rink-Amide-MBHA resin, 0.015 mmol), followed by the stepwise coupling of a functionalized alkane ($NH_2(CH_2)_7COOH$), and an Fmoc-protected Lys (side-chain protected with 4-methyltrityl (Mtt)) to the N-terminus. Standard SPPS methods were then employed for the step-wise addition of the *S. mutans* targeting peptide M8 plus a tri-Gly linker region (TFFRFLNR-GGG (SEQ ID NO:1950)) to the N-terminal of the central Lys. After assembly of Fmoc-M8-GGG-K(Mtt)-$(CH_2)_7$CO-BD2.20 (SEQ ID NO:1951), the Fmoc group was removed with 25% piperidine in DMF and the N-terminal was re-protected with an acetyl group with $Ac_2O$/DIEA (1:1, 20 molar excess) for 2 hours. The Mtt-protected amino group of the central Lys was then selectively exposed with 2% TFA in DCM (1.5 mL) for 15 minutes (three cycles of 5 min). The resulting product was reloaded into the synthesizer and the peptide sequence built from the Lys side-chain was completed with standard Fmoc SPPS methods. As shown in FIG. 13, the completed MH-STAMP M8(KH)-20 contained the side-chain peptide KH (Pseudomonas spp.-targeting, KKHRKHRKHRKH-GGG (SEQ ID NO:1952)), while in MH-STAMP M8(BL)-20 a peptide with no bacterial binding (data not shown), BL-1 (DAANEA-GGG; SEQ ID NO:2007), was utilized. BL(KH)-20 was constructed identically to M8(KH)-20, utilizing BL-1 in place of M8 (FIG. 13).

Microbial Population Shift Assay

Mixed planktonic populations of P. aeruginosa, E. coli, S. epidermidis, and S. mutans were utilized to examine the potential of MH-STAMPs to direct species composition within a culture after treatment. Samples were prepared containing: ~6×10$^4$ cfu/mL S. mutans, ~2×10$^4$ cfu/mL E. coli, ~2×10$^4$ cfu/mL S. epidermidis, and ~0.5×10$^4$ cfu/mL P. aeruginosa in BHI (mixed immediately before peptide addition). Peptide (10 µM) or mock-treatment (1×PBS) was then added and samples were incubated at 37° C. for 24 h under anaerobic conditions (80% N2, 15% CO$_2$, 5% H2). After incubation, samples were serially diluted (1:10) in 1×PBS and aliquots from each dilution were then spotted to agar

TABLE 14

MICs of MH-STAMPs and component peptides.

| | MIC (µM) | | | | | |
|---|---|---|---|---|---|---|
| | P. aeruginosa | E. coli | K. pneumoniae | S. mutans | S. epidermidis | S. aureus |
| BD2.20 | 14.4 ± 4.40 | 5.47 ± 1.41 | 2.98 ± 0.47 | 2.86 ± 0.60 | 5.11 ± 1.58 | 5.625 ± 1.29 |
| M8(KH)-20 | 11.95 ± 3.32 | 2.72 ± 0.59 | 3.13 | 6.25 | 3.13 | 5.64 ± 1.07 |
| M8(BL)-20 | 50 | 5.97 ± 0.94 | 6.88 ± 1.98 | 6.25 | 6.25 | 18.05 ± 6.58 |
| BL(KH)-20 | 27.5 ± 7.90 | 6.25 | 6.25 | 6.25 | 6.25 | 6.25 |

Average MIC with standard deviation, n = 10 assays.

Synthesis progression was monitored by the ninhydrin test, and completed peptides cleaved from the resin with 95% TFA utilizing appropriate scavengers, and precipitated in methyl tert-butyl ether. Purification and MH-STAMP quality was confirmed by HPLC (Waters, Milford, Mass.) using a linear gradient of increasing mobile phase (acetonitrile 10 to 90% in water with 0.1% TFA) and a Waters XBridge BEH 130 C18 column (4.6×100 mm, particle size 5 µm). Absorbance at 215 nm was utilized as the monitoring wavelength, though 260 and 280 nm were also collected. LC spectra were analyzed with MassLynx Software v.4.1 (Waters). Matrix-assisted laser desorption ionization (MALDI) mass spectroscopy was utilized to confirm correct peptide mass (Voyager System 4291, Applied Biosystems) [18].

MIC Assay

Peptides were evaluated for basic antimicrobial activity by broth microdilution, as described previously [10, 11]. Briefly, ~1×10$^5$ cfu/mL bacteria were diluted in TH (S. mutans), or Mueller-Hinton (MH) broth (all other organisms) and distributed to 96-well plates. Serially-diluted (2-fold) peptides were then added and the plates incubated at 37° C. for 18-24 h. Peptide MIC was determined as the concentration of peptide that completely inhibited organism growth when examined by eye (clear well). All experiments were conducted 10 times.

Post-Antibiotic Effect Assay

The activity and selectivity of MH-STAMPs after a 10 min incubation was determined by growth retardation experiments against targeted and untargeted bacteria in monocultures, as described previously [10, 11]. Cells from overnight cultures were diluted to ~5×10$^6$ cfu/mL in MH (or TH with 1% sucrose for S. mutans), normalized by OD600 0.05-0.1 and seeded to 96-well plates. Cultures were then grown under the appropriate conditions for 2 h (3 h for S. mutans) prior to the addition of peptides for 10 min. Plates were then centrifuged at 3000×g for 5 min, the supernatants discarded, fresh medium returned (MH or TH without sucrose for S. mutans), and incubation resumed. Bacterial growth after treatment was then monitored over time by OD600.

plates selective for each species in the mixture: TH plus 800 µg/mL spectinomycin (S. mutans), LB plus 25 µg/mL ampicillin (P. aeruginosa), LB plus 200 µg/mL spectinomycin (E. coli), and mannitol salt agar (MSA, S. epidermidis) in order to quantitate survivors from each species. Plates were then incubated 37° C. under aerobic conditions (TH plates were incubated anaerobically) and colonies counted after 24 h to determine survivors. Expected colony morphologies were observed for each species when plated on selective media. Gram stains and direct microscopic observation (from select isolated colonies) were undertaken to confirm species identity (data not shown). The detection limit of the assay was 200 cfu/mL.

Results

Design and Synthesis of Multi-Headed STAMPs

Figure 14A:
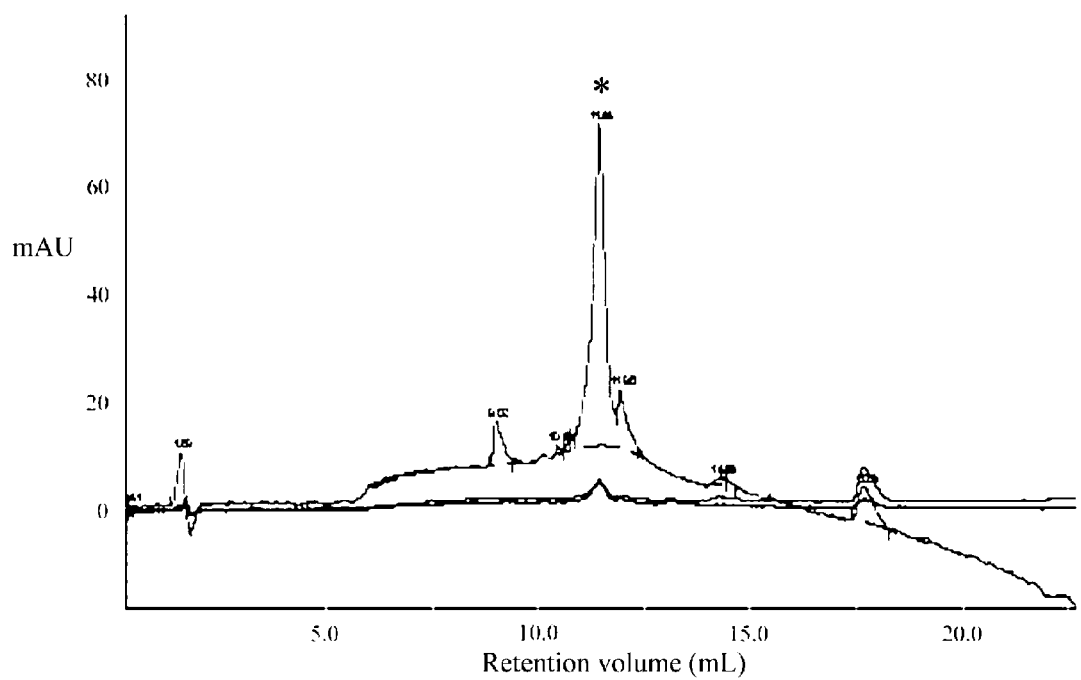
FIGS. 14A and 14B show HPLC and MS spectra of M8(KH)-20. The quality of the completed MH-STAMP was analyzed by HPLC (FIG. 14A) and MALDI mass spectroscopy (FIG. 14B). At UV absorbance 215 nm (260 and 280 nm are also plotted), a single major product was detected by HPLC (* retention volume 11.04 mL). After fraction collection, the correct mass (m/z) for single-charged M8(KH)-20, 4884.91 (marked by *), was observed for this peak. Y-axis: 14A, mAU miliabsorbance units; 14B, percent intensity.
Figure 14B:
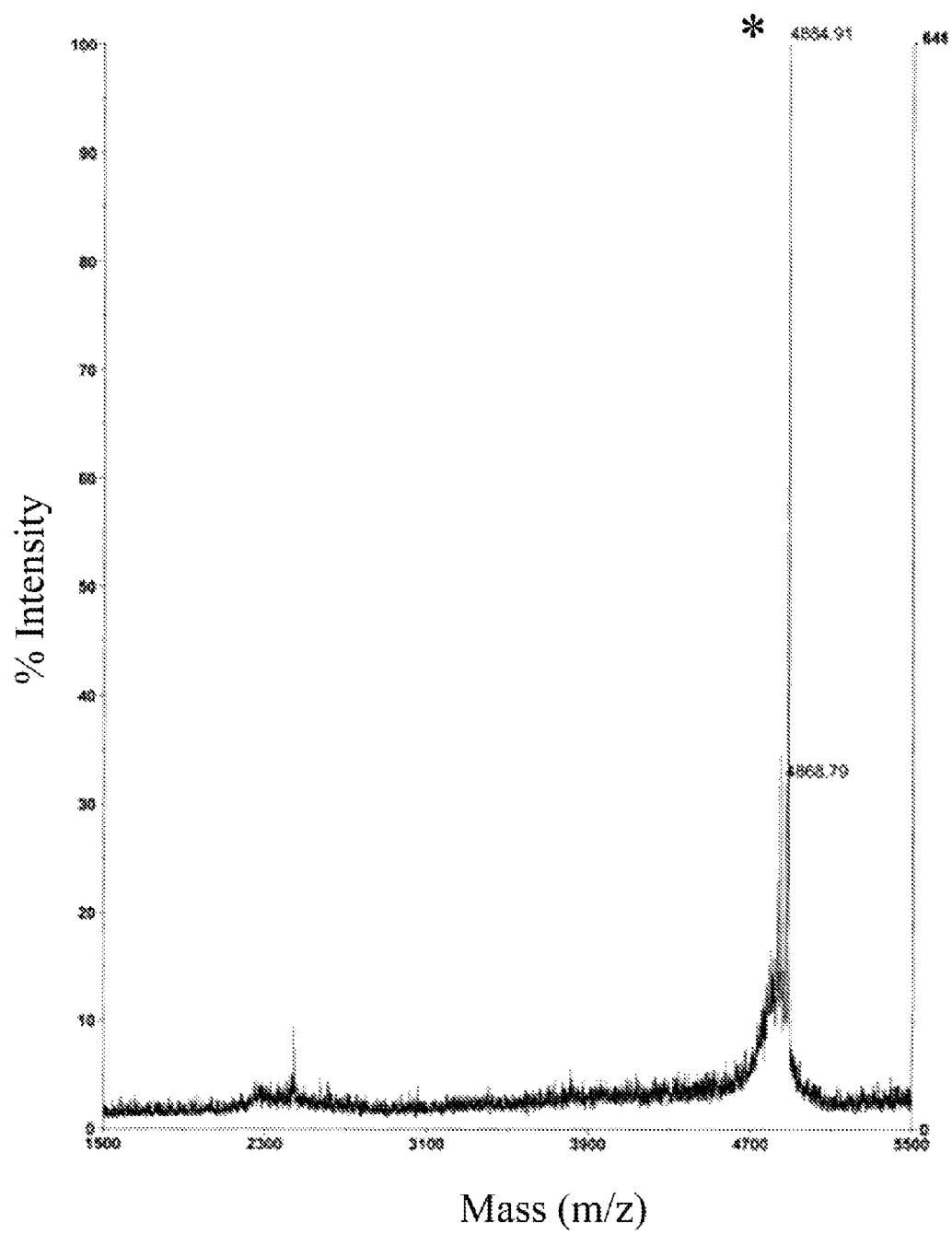

We constructed a prototype MH-STAMP from the well-established targeting peptides KH (specific to Pseudomonas spp) and M8 (specific for Streptococcus mutans). The wide-spectrum antimicrobial peptide BD2.20 was utilized as the base AMP for all MH171 STAMP construction. BD2.20 is a novel synthetic AMP with a cationic and amphipathic residue arrangement, which has robust MICs against a variety of Gram-negative and Gram-positive organisms (Table 14). For the synthesis of MH-STAMP M8(KH)-20 (construct presented in FIG. 13), BD2.20 and a Lys (Mtt-protected side-chain) residue were joined via an activated alkane spacer, followed by addition of the M8 targeting peptide to the N-terminus of the product. Selective deprotection of the central Lys(Mtt) side chain was then undertaken and the KH targeting peptide attached. The correct molecular mass (4888.79) and ~90% purity was confirmed by HPLC and MALDI mass spectrometry (FIG. 14).

The non-binding "blank" targeting peptide BL-1 was incorporated into the synthesis scheme in place of KH or M8 to construct variant MH-STAMPs possessing a single functional targeting head: M8(BL)-20 and BL(KH)-20. The correct MW and acceptable purity were observed for these MH-STAMPs (FIG. 13, data not shown).

General Antimicrobial Activity of Multi-Head Constructs

After synthesis, the completed MH-STAMPs were evaluated for general antimicrobial activity by MIC against a panel of bacteria. As shown in Table 14, the MH-STAMP constructs M8(KH)-20, BL(KH)-20, and M8(BL)-20 were found to have similar activity profiles to that of BD2.20 for the organisms examined (less than two titration steps in 10-fold difference). Additionally, we observed a difference in general susceptibility between *P. aeruginosa* and the other organisms tested, suggesting this bacterium is more resistant to BD2.20. Overall, these data indicate that the addition of the targeting domains to the base sequence was tolerated and did not completely inhibit the activity of the antimicrobial peptide.

Peptide selectivity could not be determined utilizing these methods, as STAMPs and their parent AMP molecules often display similar MICs, but have radically different antimicrobial kinetics and selectivity due to increased specific-killing mediated by the targeting regions [10, 11]. Therefore, we performed different experiments to test for antimicrobial selectivity and functional MH-STAMP construction.

3.3 Selectivity and Post-Antibiotic Effect of MH-STAMP Constructs

Figure 15A:
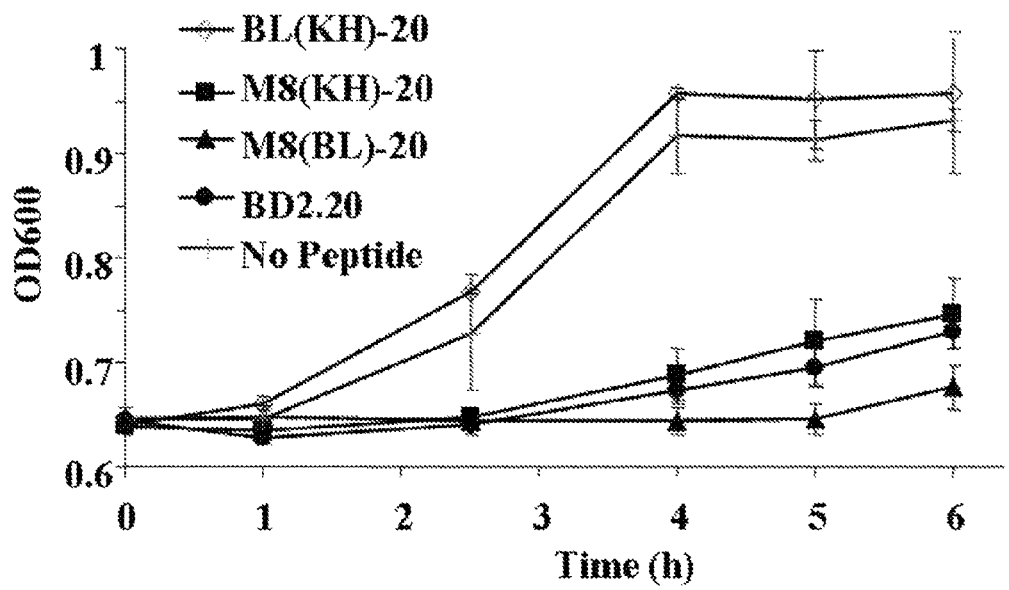
FIG. 15A-15E show growth inhibitory activity of MH-STAMPs. Monocultures of S. mutans (FIG. 15A); P. aeruginosa (FIG. 15B); S. epidermidis (FIG. 15C); S. aureus (FIG. 15D); or E. coli (FIG. 15E); were treated with peptides (as indicated in the figure) for 10 min. Agent was then removed and fresh media returned. Culture recovery was measured over time (OD600). Plots represent the average of at least 3 independent experiments with standard deviations.
Figure 15B:
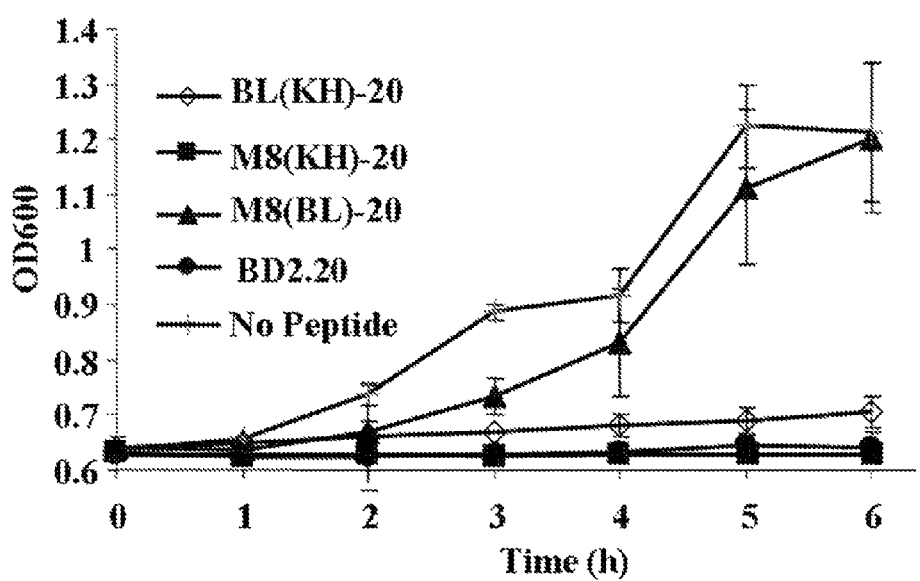
Figure 15C:
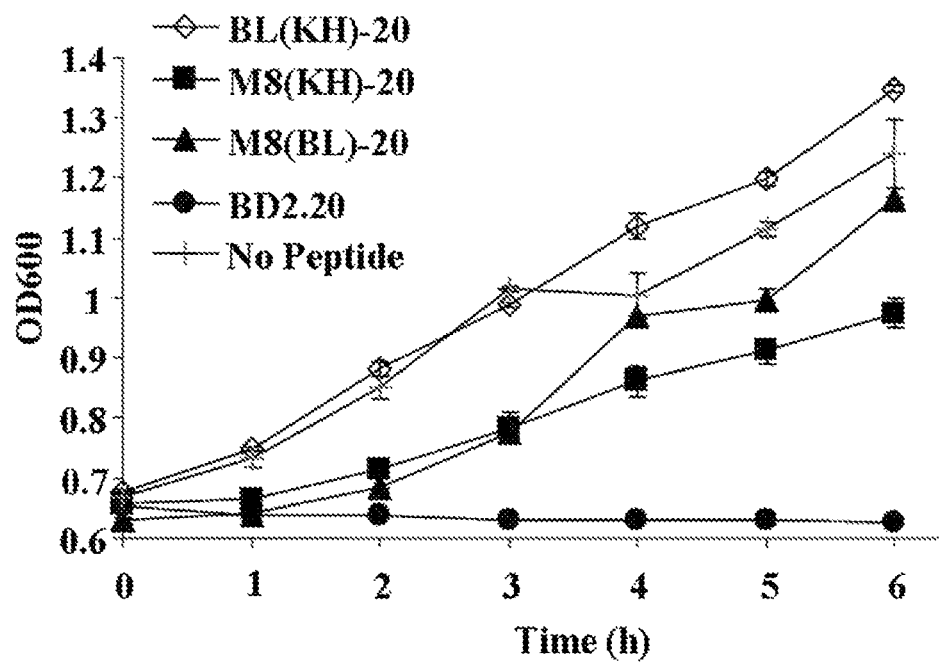
Figure 15D:
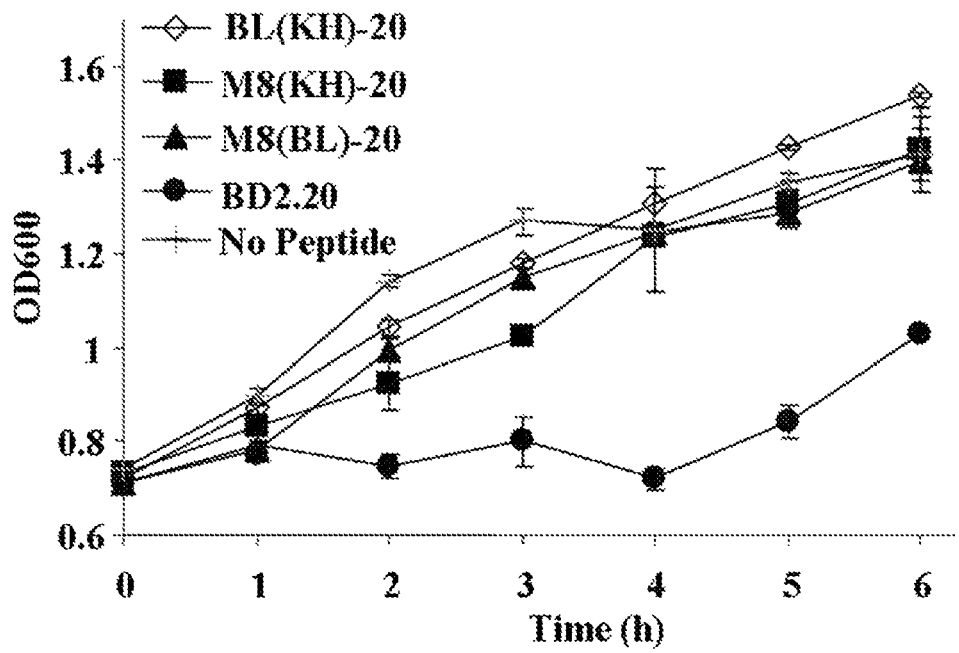
Figure 15E:
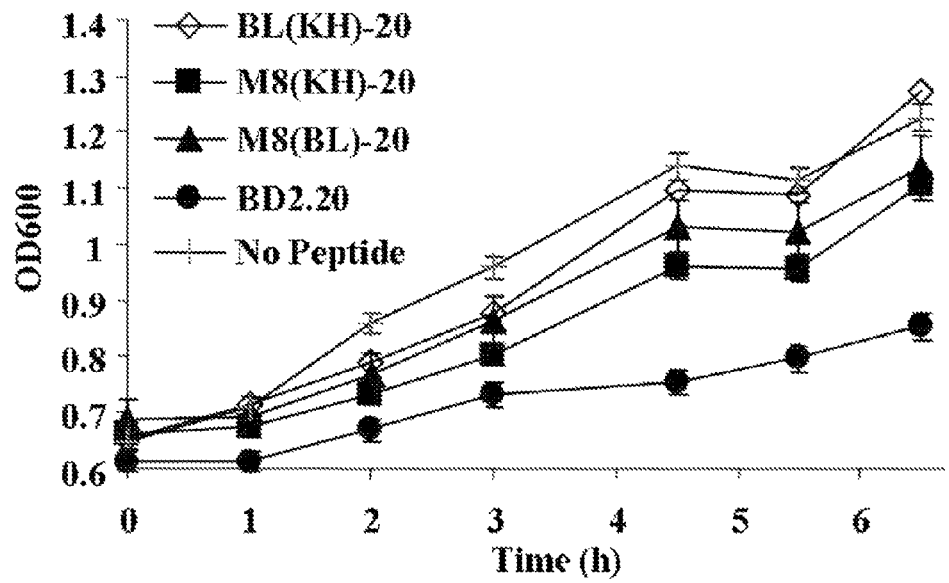

MH-STAMP antimicrobial kinetics was ascertained utilizing a variation of the classical post-antibiotic effect assay, which measures the ability of an agent to affect an organism's growth after a short exposure period. Monocultures of MH-STAMP-targeted and untargeted organisms were exposed to M8(KH)-20, M8(BL)-20, BL(KH)-20, or unmodified BD2.20, then allowed to recover. As shown in FIG. 15A, *S. mutans* growth was effectively retarded by M8-containing constructs (M8(KH)-20, M8(BL)-20), but was not altered by a MH-STAMP construct lacking this region (BL(KH)-20). Similarly, the growth of the other targeted bacterium, *P. aeruginosa*, was inhibited in a KH-dependant manner (FIG. 15B). In comparison, the non-targeted bacteria *E. coli*, *S. aureus*, and *S. epidermidis* were not inhibited by treatment with any MH-STAMP and were only inhibited by the base antimicrobial peptide BD2.20, which displayed robust antimicrobial activity against all examined strains. These results indicate that MH-STAMPs containing KH or M8 targeting domains have activity against *P. aeruginosa* or *S. mutans*, respectively, and not other bacteria. Furthermore, replacement of the targeting region with a non-binding peptide abolishes specific activity.

Figure 16:
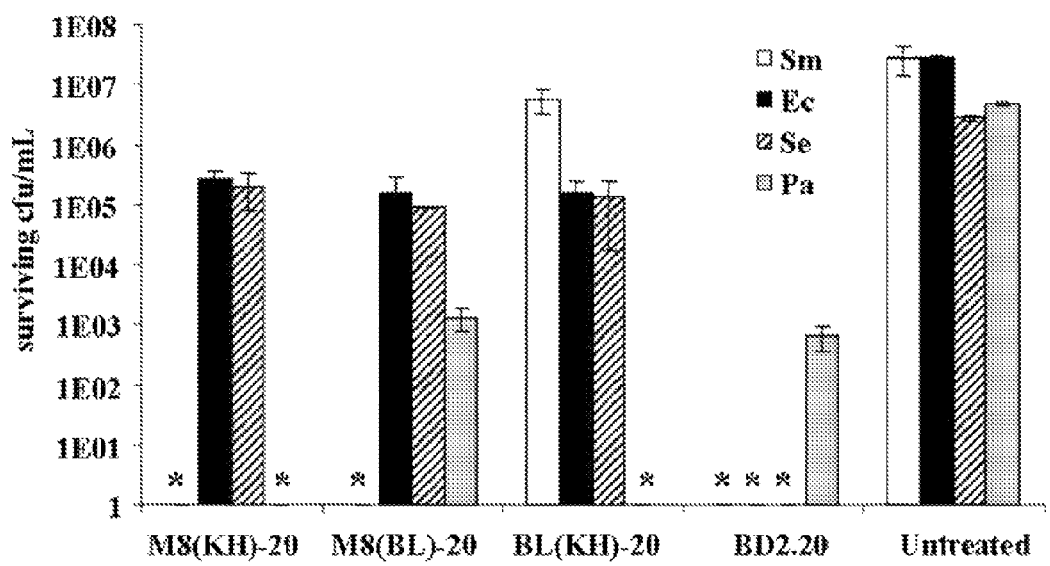
FIG. 16 illustrates the selective activity of dual-targeted and single-targeted MH-STAMPs in mixed culture. A mixture of P. aeruginosa (Pa), S. mutans (Sm), E. coli (Ec), and S. epidermidis (Se) planktonic cells were mixed with MH-STAMPs (as indicated in the figure) and treated 24 h. After incubation, cfu/mL of remaining constituent species were quantitated after plating to selective media. * indicates under 200 surviving cfu/mL recovered.

Ability of MH-STAMPs to Direct a "Population Shift" within a Mixed Species Population We hypothesized that potential MH-STAMP dual-functionality could affect a particular set of bacteria within a mixed population, thereby promoting the outgrowth of non-targeted organisms and "shifting" the constituent makeup. To examine this possibility, defined mixed populations of planktonic cells were treated continuously and the make-up of the community examined after 24 h. As shown in FIG. 16, treatment with the wide spectrum AMP BD2.20 resulted in a significant loss of recoverable cfu/mL after 24 h from all species in the mixture. Treatment with M8(KH)-20 was found to alter this pattern; we observed ~1×10$^5$ cfu/mL surviving *E. coli* and *S. epidermidis*, but did not recover *S. mutans* or *P. aeruginosa* cfu/mL. In BL(KH)-20 treated samples, *P. aeruginosa* cfu/mL were not observed, though we recovered higher than input cfu/mL from *S. mutans* and unchanged numbers of *S. epidermidis* and *E. coli*. In samples exposed to M8(BL)-20, *S. mutans* recoverable cfu/mL were greatly reduced compared to input cfu/mL, while other species were not affected or affected to a lesser extent. Interestingly, these results suggest that M8(KH)-20, M8(BL)-20, and BL(KH)-20 retain their ability to affect organisms recognized by the targeting regions present, even within a mixed population of bacteria.

Discussion

Our results indicate that we have successfully constructed a STAMP with dual antimicrobial specificities controlled by the targeting peptides present in the molecule; KH for *Pseudomonas* spp, M8 for *S. mutans*. In a closed multi-species system (FIG. 16), the dual specificity of M8(KH)-20 was readily discernable: the population of the culture "shifted" away from targeted organisms after MH-STAMP treatment. The targeted bacteria were eliminated and the population of untargeted organisms increased, to varying degrees, above-input cfu/mL. Additionally, interruption of KH or M8 in the MH-STAMP construct with the non-binding peptide BL-1 resulted in the expected elimination of only one targeted species. These results support the hypothesis that functional MH-STAMPs could be constructed from a wide-spectrum AMP base.

The emergence of metagenomics and the development of more sensitive molecular diagnostics has driven an increase in the understanding of human-associated microbial ecologies and host-microbe interactions [19-21]. At mucosal surfaces, it has become clear that our bodies harbor an abundance of residential flora which may impact innate and humoral immunity, nutrient availability, protection against pathogens, and even host physiology [22-25]. Furthermore, findings have indicated that shifts in the diversity of normal flora are associated with negative clinical consequences; for example the overgrowth of *S. mutans* in the oral cavity during cariogenesis (linked to the uptake of sucrose) or the antibiotic-assisted colonization of the intestine by *Clostridium difficle* [26, 27]. Other population shifts may be linked to axilla odor (*Corynebacteria* spp) [28, 29], or even host obesity. Given the quantity and diversity of microbes present, pathogenesis at mucosal surfaces is not likely to be associated with the overgrowth of a single strain or species. More often, it is a population shift resulting in the predominance of two or more species; for example the persistence of *Burkholderia cepacia* and *P. aeruginosa* in cystic fibrosis airway or *Treponema denticola* and *Porphymonas gingivalis* and other "red cluster" organisms in gingivitis [30, 31]. In many cases (such as the latter) these species may have only distant phylogenetic relationships and display differential susceptibilities to antibiotic therapies resulting in persistent disease progression despite treatment [32, 33]. Currently, available treatments for infections of mucosal surfaces are largely non-specific (traditional small-molecule antibiotics, mechanical removal), and thus are not effective in retaining flora or shifting the constituent balance back to a health-associated composition [34]. There is a need for a therapeutic treatment that can selectively target multiple pathogens, regardless of their phylogenetic relationship, and MH-STAMPs can help achieve this goal.

In monoculture experiments (FIG. 15), our results suggest that M8 or KH inclusion in the MH-STAMP drove activity towards *S. mutans* or *P. aeruginosa*, but also that the presence of a targeting domain reduced the activity of the parent AMP BD2.20 against untargeted organisms. In contrast, the results of our MIC assays (Table 14) indicate little difference in activity between BD2.20 and any MH-STAMP. Against untargeted organisms, the M8 and KH regions are likely to have a negative, but not completely inhibitory, impact on BD2.20 activity. Given the long duration of activity and the lower inoculum size in the MIC assay (compared with experiments in FIG. 15), it is likely that all BD2.20-containing peptides could reach equal levels of growth inhibition, despite large and target-specific differences in antimicrobial speed. This pattern of results was also observed when comparing MICs of targeted and untargeted organisms utilizing STAMPs against *S. mutans* and *Pseudomonas mendocina* [10, 11].

Although more rigorous studies and a more medically relevant combination of pathogen targets is desirable, these findings indicate that it is possible to design an antimicrobial peptide-based therapeutic with multiple and defined fidelities in vitro. MH-STAMPs may help improve human health through the promotion of healthy microbial constituencies.

REFERENCES

1. Ganz T. Defensins: antimicrobial peptides of innate immunity. Nat Rev Immunol 2003; 3:710-20.
2. Hancock R E, Lehrer R. Cationic peptides: a new source of antibiotics. Trends Biotechnol 1998; 16:82-8.
3. Genco C A, Maloy W L, Kari U P, Motley M. Antimicrobial activity of magainin analogues against anaerobic oral pathogens. Int J Antimicrob Agents 2003; 21:75-8.
4. He J, Eckert R, Pharm T, et al. Novel synthetic antimicrobial peptides against *Streptococcus mutans*. Antimicrob Agents Chemother 2007; 51:1351-8.
5. Brogden K A. Antimicrobial peptides: pore formers or metabolic inhibitors in bacteria? Nat Rev Microbiol 2005; 3:238-50.
6. Muhle S A, Tam J P. Design of Gram-negative selective antimicrobial peptides. Biochemistry 2001; 40:5777-85.
7. Tossi A, Sandri L, Giangaspero A. Amphipathic, alpha-helical antimicrobial peptides. Biopolymers 2000; 55:4-30.
8. Tam J P, Lu Y A, Yang Y L. Antimicrobial dendrimeric peptides. European Journal of Biochemistry 2002; 269:923-32.
9. Pini A, Giuliani A, Falciani C, Runci Y, Ricci C, Lelli B, et al. Antimicrobial Activity of Novel Dendrimeric Peptides Obtained by Phage Display Selection and Rational Modification. Antimicrob Agents Chemother 2005; 49:2665-72.
10. Eckert R, He J, Yarbrough D K, Qi F, Anderson M H, Shi W. Targeted killing of *Streptococcus mutans* by a pheromone-guided "smart" antimicrobial peptide. Antimicrob Agents Chemother 2006; 50:3651-7.
11. Eckert R, Qi F, Yarbrough D K, He J, Anderson M H, Shi W. Adding selectivity to antimicrobial peptides: rational design of a multidomain peptide against *Pseudomonas* spp. Antimicrob Agents Chemother 2006; 50:1480-8.
12. Drake J W, Charlesworth B, Charlesworth D, Crow J F. Rates of Spontaneous Mutation. Genetics 1998; 148:1667-86.
13. Eckert R, Brady K M, Greenberg E P, Qi F, Yarbrough D K, He J, et al. Enhancement of Antimicrobial Activity against *Pseudomonas aeruginosa* by Coadministration of G10KHc and Tobramycin Antimicrob Agents Chemother 2006; 50:3833-8.
14. Sprenger G A, Lengeler J W. L-Sorbose metabolism in *Klebsiella pneumoniae* and Sor+ derivatives of *Escherichia coli* K-12 and chemotaxis toward sorbose. J Bacteriol 1984; 157:39-45.
15. Podbielski A, Spellerberg B, Woischnik M, Pohl B, Lütticken R. Novel series of plasmid vectors for gene inactivation and expression analysis in group A streptococci (GAS). Gene 1996; 177:137-47.
16. Duthie E S, Lorenz L L. Staphylococcal coagulase; mode of action and antigenicity. J Gen Microbiol 1952; 6:95-107.
17. Merritt J, Kreth J, Qi F, Sullivan R, Shi W. Non-disruptive, real-time analyses of the metabolic status and viability of *Streptococcus mutans* cells in response to antimicrobial treatments. J Microbiol Methods 2005; 61:161-70.
18. Anderson R C, Rehders M, Yu P L. Antimicrobial fragments of the pro-region of cathelicidins and other immune peptides. Biotechnol Lett 2008; 30:813-8.
19. Aas J A, Paster B J, Stokes L N, Olsen I, Dewhirst F E. Defining the normal bacterial flora of the oral cavity. J Clin Microbiol 2005; 43:5721-32.
20. Boman H G. Innate immunity and the normal microflora. Immunol Rev 2000; 173:5-16.
21. Kreth J, Merritt J, Shi W, Qi F. Competition and coexistence between *Streptococcus mutans* and *Streptococcus sanguinis* in the dental biofilm. J Bacteriol 2005; 187:7193-203.
22. Metges C C. Contribution of Microbial Amino Acids to Amino Acid Homeostasis of the Host. J Nutr 2000; 130: 1857 S-64.
23. Sears C L. A dynamic partnership: Celebrating our gut flora. Anaerobe 2005; 11:247-251.
24. Lievin-Le Moal V, Servin A L. The Front Line of Enteric Host Defense against Unwelcome Intrusion of Harmful Microorganisms: Mucins, Antimicrobial Peptides, and Microbiota Clin Microbiol Rev 2006; 19:315-37.
25. DiBaise J K, Zhang H, Crowell M D, Krajmalnik-Brown R, Deckert G A, Rittmann B E. Gut microbiota and its possible relationship with obesity. Mayo Clinic Proceedings 2008; 83:460-9.
26. Loesche W J. Role of *Streptococcus mutans* in human dental decay. Microbiol. Rev 1986; 50:353-80.
27. Gould C V, McDonald L C. Bench-to-bedside review: *Clostridium difficile* colitis. Crit. Care 2008; 12:203.
28. Leyden J J, McGinley K J, Holzle E, Labows J N, Kligman A M. The microbiology of the human axilla and its relationship to axillary odor. J Invest Dermatol 1981; 77:413-6.
29. Elsner P. Antimicrobials and the skin physiological and pathological flora. Curr Probl Dermatol 2006; 33:35-41.
30. Govan J R, Deretic V. Microbial pathogenesis in cystic fibrosis: mucoid *Pseudomonas aeruginosa* and *Burkholderia cepacia*. Microbiol. Rev 1996; 60:539-74.
31. Paster B J, Boches S K, Galvin J L, Ericson R E, Lau, C N, Levanos, V A, et al. Bacterial diversity in human subgingival plaque. J Bacteriol 2001; 183:3770-83.
32. Schlessinger D. Failure of aminoglycoside antibiotics to kill anaerobic, low-pH, and resistant cultures. Clin Microbiol Rev 1988; 1:54-9.
33. Tresse O, Jouenne T, Junter G. Antibacterial efficacy of tobramycin against anaerobic *Escherichia coli* cultures in the presence of electron acceptors J Antimicrob Chemother 1997; 40:419-21.
34. Keene H J, Shklair I L. Relationship of *Streptococcus mutans* carrier status to the development of carious lesions in initially cariesfree recruits. J Dent Res 1974; 53:1295.
35. Perron G G, Zasloff M, Bell G. Experimental evolution of resistance to an antimicrobial peptide. Proc Biol Sci 2006; 273:251-6.

Example 2

Synthesis of Peptide-Porphyrin Conjugate

The mixture of coupling reagent HATU (5 eq. excess, 10 mg) and purpurin-18 (MW 564, 5 eq excess, 15 mg) in 600 mL dry dichloromethane (DCM):DMF:dimethylsulphoxide (DMSO) (1:1:1 (v/v)) was added to the peptide resin (1 molar equivalent, 15 mg) which was swelled by placing in minimal DMF for 30 min prior to reaction. 26 µL (10 molar equivalents) DIPEA was then added to the reaction flask to initiate the reaction. The reaction mixture was protected with argon and stirred at room temperature for 3 h.

After finishing, the reaction mixture was then passed down a sintered glass filtered vial and extensively washed with DMF and DCM to remove all waste reagents. The resin was then dried overnight in vacuum, and cleaved with 1 ml of trifluoroacetic acid (TFA)/thioanisole/water/EDT (10/0.5/0.5/025) for 2 hr at room temperature, and the cleavage solution was precipitated with 10 mL methyl-tert butyl ether. The precipitate was washed twice with the same amount of ether.

Example 3

Synthesis of Peptide-CSA Conjugate

To the fully protected peptide (solution of B43-GGG (FIDSFIRSF-GGG (SEQ ID NO:2008), 0.025 mmol) and tri-Boc-CSA-15 (0.0125 mol) in 300 µL DMF, DCC (7.7 mg), HOBt (5.1 mg) and 13 µL DIEA were added in iced-bath. After stirred at room temperature for four days, the reaction mixture was poured into 5 ml water and extracted with chloroform (5×3 mL). The $CHCl_3$ extract was evaporated under vacuum and dried in a lyophilizer overnight. The dried $CHCl_3$ extracts was then dissolved in 1 mL DCM followed by added 1 mL of TFA in iced-bath. The reaction mixture was further stirred at room temperature for 2 hours and precipitated with methyl tert-butyl ether (10 mL). The precipitate was further washed once with the same amount ether and dried in vacuum.

Example 4

Systemically Designed STAMPS Against *S. Mutans*

We previously reported a novel strategy of "targeted-killing" with the design of narrow-spectrum molecules known as specifically-targeted antimicrobial peptides (STAMPs). Construction of these molecules requires the identification and the subsequent utilization of two conjoined yet functionally independent peptide components: the targeting and killing regions. In this study, we sought to design and synthesize a large number of STAMPs targeting *Streptococcus mutans*, the primary etiological agent of human dental caries, in order to identify candidate peptides with increased killing speed and selectivity when compared with their unmodified antimicrobial peptides (AMP) precursors. We hypothesized that a combinatorial approach utilizing a set number of AMP, targeting, and linker regions, would be an effective method for the identification of STAMPs with the desired level of activity. STAMPs composed of the *S. mutans* binding peptide 2_1 and the AMP PL-135 displayed selectivity at minimal inhibitory concentrations after incubation for 18-24 h. STAMPs where PL-135 was replaced by the B-33 killing domain exhibited both selectivity and rapid killing within one minute of exposure. These results suggest that potent and selective STAMP molecules can be designed and improved via a tunable "building-block" approach.

Introduction

Pathogenic microorganisms have been a continuous source of human suffering and mortality throughout the course of human history and have spurred the clinical development of novel therapeutics. Even today, the overall burden of infectious disease remains high, constituting a leading (and rising) cause of death worldwide (12, 13). The conventional medical response to bacterial infections, small molecule antibiotics, have become less effective against emerging pathogens due to the evolution of drug-resistance stemming in part from the misuse of antibiotics (11). To counter the rapid progression of antibiotic resistance there is an urgent need for the development of novel lead compounds for clinical applications.

Our strategy for creating new antibacterial agents is based on the addition of a targeting peptide to an existing broad-spectrum antimicrobial peptide, thereby generating a specifically-targeted antimicrobial peptide (STAMP) selective for a particular bacterial species or strain. A completed STAMP consists of conjoined but functionally independent targeting and killing regions, separated by a small flexible linker, all within a linear peptide sequence. The STAMP targeting region drives enhancement of antimicrobial activity by increasing binding to the surface of a targeted pathogen, utilizing specific determinants such as overall membrane hydrophobicity and charge, pheromone receptors, etc., which in turn leads to increased selective accumulation of the killing moiety (6, 7).

As both the killing and targeting regions of the STAMP are linear peptides, we approached the design process using a tunable combinatorial methodology where, for example, the targeting peptide component is held constant, while a number of killing peptides are conjoined utilizing a variety of linker molecules, or vise versa, in order to generate a library of related STAMPs. Previously, we successfully demonstrated a pilot version of this approach when constructing G10KHc (6), a STAMP with *Pseudomonas*-spp selective activity, and when designing C16G2 (7), a STAMP specific for *Streptococcus mutans*, the leading causative agent of human tooth decay. In this study, synthetic targeting and antimicrobial peptide libraries were utilized as building blocks to generate a number of novel STAMPs with high *S. mutans*-selective activity. STAMPs designed by these methods were then improved through tuning the linker and killing peptides present to yield completed lead STAMP molecules that demonstrated activity against *S. mutans* biofilms.

Materials and Methods

Reagents. Wang resin, Rink-MBHA resin, p-Benzyloxybenzyl alcohol resin (100-200 mesh), 9-fluorenylmethoxycarbonyl (Fmoc) amino acids, N-hydroxybenzotriazole hydrate (HOBT) and 2-(1H-benzotriazol-1-yl)-1,1,3,3-tetramethyluronium hexafluorophosphate (HBTU) were obtained from Anaspec (San Jose, Calif.). All other solvents and reagents were purchased from Fisher Scientific (Pittsburgh, Pa.) at HPLC or peptide synthesis grade.

Bacterial Growth All *S. mutans* (UA159) (1), *Streptococcus gordonii* Challis (DL 1), *Streptococcus sobrinus* ATCC 33478, and *Streptococcus sanguinis* NY101 strains were grown in Brain Heart Infusion (BHI) medium at 37° C. under anaerobic conditions (80% $N_2$, 10% $CO_2$, 10% $H_2$) (6). *Pseudomonas aeruginosa* (PAK) (17), and *Escherichia coli* W3110 (20), were cultured in Luria-Bertani (LB) medium under an aerobic atmosphere at 37° C. Methicillin-resistant *Staphylococcus aureus* (MRSA), and vancomycin-resistant *Enterococcus faecium* (VRE) were grown in BHI under aerobic conditions at 37° C. (4).

Peptide Syntheses and Purification. Peptides were synthesized using standard solid phase (Fmoc) chemistry with an Apex 396 peptide synthesizer (AAPPTec, Louisville, Ky.) at a 0.01 mM scale. N-terminal deblocking during linear peptide synthesis was conducted with 0.6 mL of 25% (v/v) piperidine in dimethylformamide (DMF), followed by agitation for 27 min and wash cycles of dichlormethane DCM (1×1 mL) and NMP (7×0.8 mL). Subsequent amino acid coupling cycles were conducted with a mixture of Fmoc-protected amino acid (5 eq), HOBT (5 eq), HBTU (5 eq), DIEA (10 eq) in DMF (0.1 mL), and NMP (0.2 mL) with agitation for 45 min. The washing cycle was repeated before the next round of deprotection and coupling. After synthesis, peptides were washed in methanol and dried 24 h. Protected peptide was cleaved with 1 mL of trifluoroacetic acid (TFA)/thioanisole/water/1, 2-ethanedithiol (10/0.5/0.5/025) for 3 h at room temperature and the resultant peptide solution was precipitated in methyl tert-butyl ether.

Analytical and preparative HPLC was conducted, as described previously (5, 9), to purify each peptide to 80-90%. Correct peptide mass was confirmed by matrix-assisted laser desorption/ionization mass spectroscopy (MALDI, Voyager instrument, Applied Biosystems), as described previously (9). Measurements were made in linear, positive ion mode with an α-cyano-4-hydroxycinnamic acid matrix (data not shown).

Acetylated and benzoylated peptides derivatives (Ac135 (L1)2_1 and bz135(L1)2_1, respectively) were synthesized by the same method used for N-terminal fluorescent labeling, described previously (7). Briefly, acetylation (acetic anhydrous) or benzyl addition (benzoatic acid) was undertaken after assembly of the linear sequence by adding to the resin (10 eq in DIEA) for 2 h.

Binding of Targeting Peptides. The binding of peptides 1_2, 1_3, 1_4, 1_6, 2_1, and 3_1 was assessed by fluorescent microscopy. $S.$ $mutans$ UA159 was grown overnight and diluted 1:5000 in fresh TH with 1% sucrose before seeding to 96-well plates (flat bottom). Biofilms were grown 24 h and the spent medium replaced with 1×PBS containing 25 µM peptide. After 5 min incubation at room temperature, the supernatants were removed and the biofilms washed 2× with 1×PBS and imaged by bright-field and fluorescence microscopy (Nikon E400). Digital images were collected and analyzed for semiquantitative binding assessments with the manufacturers supplied software (SPOT, Diagnostics) (6).

Minimum Inhibitory Concentrations (MICs) of Peptides. Peptide MIC was determined by broth microdilution (6, 15). Briefly, two-fold serial dilutions of each peptide were prepared with 50% BHI medium+50% sterile water (for oral streptococci; all other bacteria were diluted in 1× Mueller-Hinton broth) at a volume of 100 µL per well in 96-well flat-bottom microtiter plates. The concentration of peptide for the first test round ranged from 500 to 2 µg/mL or 125 to 1 µg/mL. If activity was detected, a second round of MIC tests was conducted with concentrations of 62.5 to 0.5 µg/mL. In either case, the microtiter plate was inoculated with a bacterial cell suspension to a final concentration of ~1×10$^5$ cells per mL and the plates were incubated at 37° C. for 16-20 h under the appropriate conditions. After incubation, absorbance at 600 nm ($A_{600}$) was measured using a microplate UV-Vis spectrophotometer (Model 3550, BioRad, Hercules, Calif.) to assess cell growth. The MIC endpoint was calculated as the lowest concentration of antibacterial agent that completely inhibited growth or that produced at least 90% reduction in turbidity when compared with that of a peptide-free control. At least 10 independent tests were conducted per peptide. For peptides insoluble in aqueous solutions, stock solutions were prepared in methanol or ethanol and appropriate solvent controls were utilized. Cell growth was not affected by 5% (v/v) methanol or ethanol, as described previously (10).

Peptide Killing Kinetics. To determine antimicrobial kinetics and specificity, assays similar to traditional time-kill experiments were performed, as described previously (6, 7). Briefly, overnight bacterial cultures were diluted in BHI to $A_{600}$ 0.08 and peptides were added as indicated. Aliquots were then removed at various intervals and diluted 1:50 in BHI and kept on ice until plating on appropriate growth medium. After 24 hours incubation, colonies were counted and the surviving cfu/mL determined. All assays were repeated at least 3 times and the average recovered cfu/mL were presented with standard deviations. Statistical analysis was conducted utilizing an unpaired Student's t-test.

Biofilm Growth Inhibitory Assays. STAMPs were tested for anti-biofilm activity as described previously (6). Briefly, overnight cultures of $S.$ $mutans$ were diluted 1:50 in Todd-Hewitt (TH) broth medium supplemented with 0.5% sucrose and 100 µL of bacterial suspension was added to each well of a 96-well microtiter plate. After centrifugation, bacteria were then incubated under anaerobic conditions at 37° C. for 4 h. Supernatants were then removed and replaced with 25 µM peptide in 1×PBS for 30 s to 1 min, followed by removal, washing, and replacement with 100 µL fresh TH broth (without sucrose). Plates were then incubated at 37° C. under anaerobic conditions and the bacterial recovery monitored by recording $A_{600}$ after 4 h incubation. An unpaired Student's t-test was utilized for statistical analysis.

Results

STAMPs consist of 3 regions: one targeting and one antimicrobial, connected via a flexible linker. In this report, we conjoined examples of each domain with a variety of linkers to construct a pool of initial STAMP candidates. These peptides were then evaluated for anti-$S.$ $mutans$ activity and selectivity, their designs improved, and the lead STAMPs evaluated against $S.$ $mutans$ biofilms.

Selection of components and initial STAMP library design. As described elsewhere, we generated several novel $S.$ $mutans$-specific binding peptides, including 2_4, (previously S3L1-10 (FIKDFIERF; SEQ ID NO:2009)) and 1_5, (previously S3L1-5 (WWYNWWQDW; SEQ ID NO:2010)) (7). From these base sequences, residues differing in hydrophobicity and/or charge were substituted at defined positions to yield a series of related targeting sequences that were then evaluated for binding to $S.$ $mutans$ biofilms. Several of the 1_5 variants, and one of the 2_4 variants, were found to retain biofilm binding (data not shown). These sequences (1_2; 1_3; 14; 1_6; 2_1; 3_1), as well as 15, were regarded in the present study as the pool of $S.$ $mutans$ targeting peptides for STAMP construction (shown in Table 15). For the antimicrobial component, we selected PL-135, a peptide based on an AMP isolated from tunicates (19), for the initial round of design (Library 1). We hypothesized that linker regions and attachment orientation would exert an influence on STAMP activity. Therefore, we initially conjugated each potential targeting peptide to the N or C terminus of PL-135 through six different linkers, as shown in Table 15 (GGG (SEQ ID NO:1937), designated L1; SAT (SEQ ID NO:1940), L3; ASASA (SEQ ID NO:1944), L5; PYP (SEQ ID NO:1941), L7; PSGSP (SEQ ID NO:1932), L8; PSPSP (SEQ ID NO:1942), L9) leading to the synthesis of 84 STAMPs.

TABLE 15

STAMP constituent regions utilized in STAMP Library 1.

| No. | S. mutans targeting peptides Sequence (SEQ ID NO:) | Linker peptides (name) (SEQ ID NO:) | Killing peptide (SEQ ID NO:) |
|---|---|---|---|
| 1_2 | WWHSWWSTW (2011) | GGG (L1) (1937) | FHFHLHF* (PL-135) (1976) |
| 1_3 | WWSYWWTQW (2012) | SAT (L3) (1940) | |

TABLE 15-continued

STAMP constituent regions utilized in STAMP Library 1.

| No. | S. mutans targeting peptides Sequence (SEQ ID NO:) | Linker peptides (name) (SEQ ID NO:) | Killing peptide (SEQ ID NO:) |
|---|---|---|---|
| 1_4 | WWKDWWERW (2013) | ASASA (L5) (1944) | |
| 1_5 | WWYNWWQDW (2010) | PYP (L7) (1941) | |
| 1_6 | WWQDWWNEW (2014) | PSGSP (L8) (1932) | |
| 2_1 | FIKHFIHRF (2015) | PSPSP (L9) (1942) | |
| 3_1 | LIKHILHRL (2016) | | |

*amidated C-terminus

Antimicrobial activity of initial STAMP library. To roughly gauge Library 1 STAMP antimicrobial activity and S. mutans-selectivity, MIC (minimal inhibitory concentration) assays were conducted against S. mutans and a panel of bacteria, including two oral streptococci, S. sanguinis and S. sobrinus (FIG. 17). STAMPs containing 2_1 conjoined to the C-terminus of PL-135 (135(L1)2_1, 135(L3)2_1, 135(L5)2_1, 135(L7)2_1, 135(L8)2_1, 135(L9)2_1), or 3_1 conjoined to the N-terminus of PL-135 (135(L1)3_1) were found to be active against S. mutans at concentrations lower than 100 µg/mL. These peptides were more active (2-4 2-fold dilution steps) against S. mutans than against the other oral streptococci or non-oral organisms tested. In contrast, native PL-135 had similar MICs against all strains examined (FIG. 17).

Impact of linker and terminal modification on STAMP antimicrobial activity. We sought to investigate the impact of linker length or type, and N-terminal modification on the activity of STAMP 135(L1)2_1 from Library 1. As shown in Table 16, altered components included: 1) new linkers GGGG (SEQ ID NO:1954) ($G_4$) to GGGGGGG (SEQ ID NO:7) ($G_7$), AAA (SEQ ID NO:1936) (L2), AGA (SEQ ID NO:8) (L10), GAGAG (SEQ ID NO:9) (L11), 8-aminocaprylic acid (LC); 2) increased N-terminal aromacity (benzoic acid addition); 3) acetylation of N-terminus; or 4) component sequence inversion (135i(L1)2_1i). We observed MICs for these Library 2 STAMPs that were similar to, or 2-fold less-active, than that of the base STAMP 135(L1)2_1 (FIG. 17), suggesting that the linker, termini and inversion alterations did not lead to improved activity against S. mutans, as measured by these means.

TABLE 16

Minimal inhibitory concentration of (MIC) of Library 2 STAMPs

| No. | Sequence (SEQ ID NO:)[a] | S. mutans (MIC)[b] |
|---|---|---|
| 135(L1)2_1 | FHFHLHFGGGFIKHFIHRF (1971) | 16 |
| 135($G_4$)2_1 | FHFHLHFGGGGFIKHFIHRF (2017) | 16 |
| 135($G_5$)2_1 | FHFHLHFGGGGGFIKHFIHRF (2018) | 16 |
| 135($G_6$)2_1 | FHFHLHFGGGGGGFIKHFIHRF (2019) | 32 |
| 135($G_7$)2_1 | FHFHLHFGGGGGGGFIKHFIHRF (2020) | 32 |
| 135(L11)2_1 | FHFHLHFSGSFIKHFIHRF (2021) | 32 |
| 135(L12)2_1 | FHFHLHFGSGSGFIKHFIHRF (2022) | 32 |
| Ac135(L1)2_1 | Ac-FHFHLHFGGGFIKHFIHRF (2023) | 32 |
| bz135(L1)2_1 | benzoate-FHFHLHFGGGFIKHFIHRF (2024) | 32 |
| 135(L2)2_1 | FHFHLHFAAAFIKHFIHRF (2025) | 16 |
| 135(L13)2_1 | FHFHLHFAGAFIKHFIHRF (2026) | 32 |
| 135(L14)2_1 | FHFHLHFGAGAGFIKHFIHRF (2027) | 32 |
| 2_1i(L1)135i | FRHIFHKIFGGGFHLHFHF (2028) | 16 |
| 135i(L1)2_1i | FHLHFHFGGGFRHIFHKIF (2029) | 16 |
| 135(LC)2_1 | FHFHLHF-[NH(CH$_2$)$_7$CO]-FIKHFIHRF (2030) | 64 |

[a] all C termini amidated
[b] MIC (µg/mL) data from all S. mutans isolates tested, with a minimum of three independent trials.

Further potential of PL-135-based STAMPs. Antiseptic mouthrinses, such as Listerine® (Warner-Lambert, Morris Plains, N.J.), are rapid-acting non-selective bactericidal agents that can inactivate viable bacteria within seconds of contact (3). In order for STAMPs to be useful mouthrinse ingredients, the antimicrobial kinetics must approach this scale. Therefore, the killing kinetics of our Library 1 and 2 STAMPs from Table 15 and FIG. 17 were evaluated (data not shown). The results indicate that these PL-135-containing STAMPs, although selective for S. mutans when measured by MIC, are not rapid killers of this bacterium in vitro, requiring several hours of exposure for observable antimicrobial activity. Therefore, we sought to improve our STAMP pool by substituting alternative killing domains for S. mutans STAMP construction.

Tuning the design of 2_1-containing STAMPs. To improve the identification of rapid-killing S. mutans STAMPs, we conjugated 2_1 with five AMPs selected from our previous studies (10), to construct Library 3: RWRWRWF (2c-4; SEQ ID NO:1860), FKKFWKWFRRF (B-33; SEQ ID NO:1821), IKQLLHFFQRF (B-38; SEQ ID NO:1826), RWRRLLKKLHHLLH (α-11; SEQ ID NO:1877), LQLLKQLLKLLKQF (α-7; SEQ ID NO:1877); attached at the C- or N-terminus. The linkers selected were L1, SGG (L2; SEQ ID NO:1938), L3 and LC. As shown in FIG. 18, MIC results indicate little difference in activity between constructs where the targeting peptide was attached to the N or C terminus of the AMP region, and little difference between linkers employed. It was also apparent that these STAMPs were more active against S. mutans relative to the other oral and non-oral bacteria tested: peptide 2_1(L1)B33 demonstrated the lowest MIC range of 4 to 8 which was a 2-4 fold improvement over the MIC for the killing peptide alone (10). Taken together, these data suggest that Library 3 STAMPs can effectively inhibit the growth of S. mutans at generally-improved potencies when compared to PL-135-containing STAMPs in Libraries 1 and 2.

Figure 19:
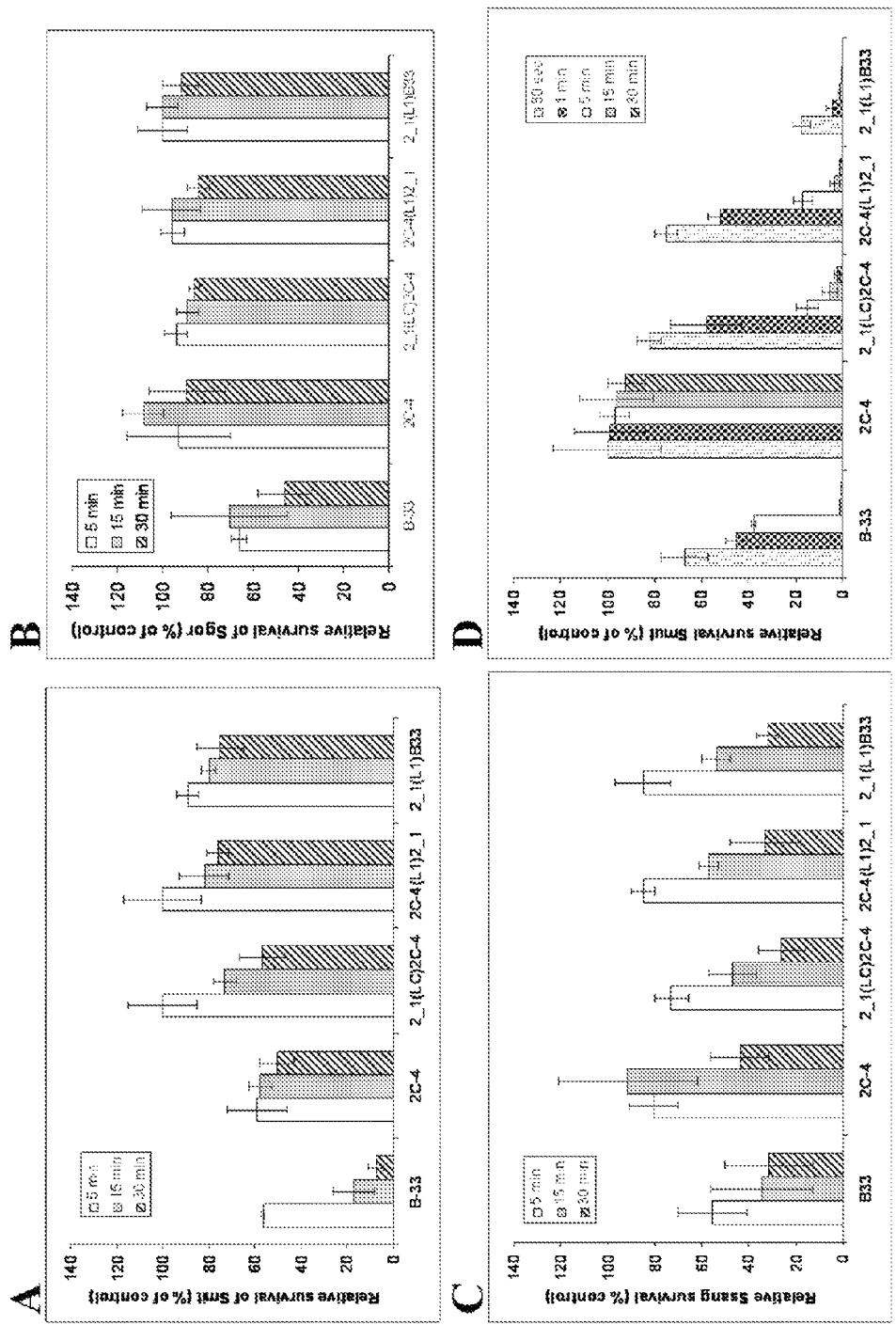
FIG. 19 shows the killing kinetics of selected peptides against oral streptococci. All tested bacteria, (A) S. mitis (Smit), (B) S. gordonii (Sgor), (C) S. sanguinis (Ssan), and (D) S. mutans (Smut), were treated with peptide solutions at 25 μg/mL for 30 s to 2 h and survivors plated. Data represent an average of three independent experiments.

STAMP killing kinetics against oral bacteria. Since the MIC assay measures antimicrobial activity after overnight incubation, large differences in killing rates between STAMPs and parental AMPs may be obscured in this assay, especially when the target organism is susceptible to the AMP (7, 9). To assess any significant selectivity and short-term antimicrobial activity of the Library 3 STAMPs, time-kill assays were performed against a variety of oral bacteria. Against the targeted bacterium S. mutans (examples shown in FIG. 19D), the STAMPs acted significantly faster than the killing peptide alone within 5 min of treatment (p<0.001 comparing B-33 alone vs. 2_1(L1)B33, or 2C-4 vs. either 2C-4-containing STAMP). In contrast, other oral streptococci, such as S. mitis and S. gordonii, were less affected by STAMP treatments (FIG. 19A-C). Peptide 2_1(L1)B33 exhibited the fastest killing kinetics and best selectivity: killing was observed even when cells were treated for as little as 30 s, a timescale more appropriate for oral cavity therapeutic applications. As expected from their wide-spectra of activities (10), parental AMPs 2C-4 and B-33 had similar levels of activity against the strains examined.

Figure 20:
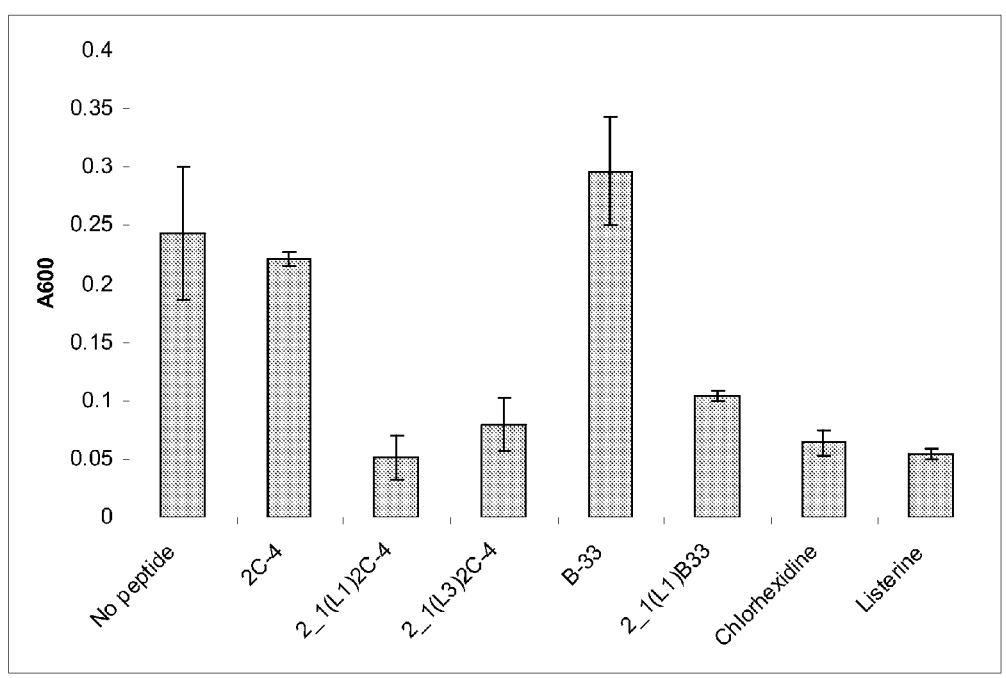
FIG. 20 illustrates the inhibitory activity of STAMPs against S. mutans biofilms. S mutans monoculture biofilms were grown and exposed to a 25 μg/mL of STAMP, unmodified parental AMP or oral antiseptic (for 1 min), washed, and replenished with fresh medium. Biofilm recovery was monitored after 4 h by A600. Data represent an average of three experiments.

Inhibition of biofilm growth. Although rapid and selective killing of S. mutans monocultures was apparent from the data shown in FIG. 19, we sought to determine whether these STAMPs would make suitable antimicrobial agents in the oral cavity, where multi-species biofilms known as dental plaque predominate (16, 18). To investigate, S. mutans biofilms were treated with STAMPs and the post-antibiotic effect was observed after 4 h of biofilm recovery. As shown in FIG. 20, STAMPs 2_1(L1)2C-4, 2_1(L6)2C-4, and 2_1(L1)B33 were found to significantly inhibit (p<0.001) the formation of biofilms when cells were treated with the peptide for 1 min at 25 µg/ml, compared to mock-treated biofilms or biofilms treated with untargeted AMP. Similar antimicrobial effects were observed for Listerine and Chlorhexidine. These results suggest that STAMP treatment persists after peptide removal at a level similar to established wide-spectrum oral antiseptics.

DISCUSSION AND CONCLUSION

In this report, we present a novel strategy for the design and synthesis of STAMPs with activity against the oral pathogen S. mutans. Successful design was achieved through a tunable, building-block approach that utilized various combinations of antimicrobial, targeting, and linker STAMP peptide regions. Our results demonstrate that less-efficacious STAMPs could be improved when alternative killing regions were substituted in the design. While it remains unclear whether the alternative moieties were more active, or simply more conjugation tolerant, this process resulted in STAMPs that displayed killing kinetics against biofilms consistent with oral therapeutic applications. Additionally, more understanding was gained regarding AMP or targeting peptide orientation dependencies, impact of linker regions, and appropriate targeting peptide choice, which could positively impact future anti-S. mutans STAMP design and refinement.

From the data presented here, it is difficult to determine the precise mechanism for the S. mutans-selectivity. Previous studies with STAMPs have indicated that the enhanced selectivity for the targeted strain is due to the binding of the targeting peptide moiety (6, 7). Although detailed binding analysis was not conducted in this study, our results suggest that a similar targeting-mediated killing is occurring here: targeting peptides, independently selected for STAMP construction on the basis of their S. mutans-binding abilities, were required to enhance AMP antimicrobial activity and selectivity.

The data presented suggest that PL-135 may be inhibited by conjugation to other peptide subunits, as unmodified PL-135 displayed activity against S. mutans that was 2 to 4-fold higher than in progeny STAMPs, as shown in FIG. 17 and Table 16 (however, these constructs were selective for S. mutans). The unusually small size of this AMP may impart a severe restriction on amino acid additions, especially if the mode of action depends on sequence-dependent self-association on the target-cell membrane, or binding to a discrete intracellular bacterial target (2). Our results suggest that AMPs with quicker "base" antimicrobial kinetics (such as B-33 or 2C-4), and higher tolerance for conjugations, should be selected for the design of STAMPs with optimal levels of enhanced killing kinetics and selectivity.

Outside of PL-135-containing examples (and potentially some α-7 and α-11 molecules, see FIG. 18), STAMPs in this report displayed no difference in activity between oppositely-oriented N and C-terminal AMP-targeting conjugations, suggesting that the optimal arrangement of STAMP domains in likely AMP-specific, and depends on which least affects the antimicrobial mechanism. For example, the Pseudomonas spp-specific STAMPs G10KHc and G10KHn (oriented target-killing and killing-target, respectively) both bind specifically to the target bacterium surface, but only G10KHc has significant membrane disruption activity (5, 7).

Interestingly, 2_1 and 3_1 containing STAMPs were active against S. mutans, and the constructs with any other targeting peptide in Table 15, were not. Targeting peptides 1_2 through 1_6 are strongly hydrophobic, compared with 2_1 and 3_1 (8), and it may be possible that this characteristic limits the dissociation of these molecules from the hydrophobic components of the S. mutans cell wall, resulting in their inhibitory affect on AMPs when conjugated, similarly to some strong LPS-binding AMPs (14). However, the systematic building-block design strategy employed allowed us to generate a diverse array of STAMPs, allowing us to identify useful compounds despite these stumbling blocks.

In conclusion, this report details the rational design of S. mutans-selective STAMPs with enhanced antimicrobial killing kinetics and selectivity when compared to untargeted AMPs. The S. mutans-selective STAMPs were constructed using a tunable, combinatorial approach that generated a diverse number of STAMP sequences for antimicrobial evaluation and improvement; a process may serve as an example for the systematic development of novel selective antimicrobial agents. We propose that these STAMPs could be useful in the design of therapeutics against oral or other mucosal pathogens, where the high diversity of "probiotic" beneficial microflora limits the effectiveness of broad-spectrum antimicrobial agents.

REFERENCES

1. Ajdic, D., W. M. McShan, R. E. McLaughlin, G. Savic, J. Chang, M. B. Carson, C. Primeaux, R. Tian, S. Kenton, H. Jia, S. Lin, Y. Qian, S. L1, H. Zhu, F. Najar, H. Lai, J. White, B. A. Roe, and J. J. Ferretti. 2002. Genome sequence of *Streptococcus mutans* UA159, a cariogenic dental pathogen. Proc Natl Acad Sci USA 99:14434-9.
2. Brogden, K. A. 2005. Antimicrobial peptides: pore formers or metabolic inhibitors in bacteria? Nat Rev Microbiol 3:238-50.
3. Charles, C. H., P. C. Pan, L. Sturdivant, and J. W. Vincent. 2000. In vivo antimicrobial activity of an essential oil-containing mouthrinse on interproximal plaque bacteria. J Clin Dent 11:94-7.
4. Chen, L., X. Cheng, W. Shi, Q. Lu, V. L. G0, D. Heber, and L. Ma. 2005 Inhibition of growth of *Streptococcus mutans*, methicillin-resistant *Staphylococcus aureus*, and vancomycin-resistant enterococci by kurarinone, a bioactive flavonoid isolated from *Sophora flavescens*. J Clin Microbiol 43:3574-5.
5. Eckert, R., K. M. Brady, E. P. Greenberg, F. Qi, D. K. Yarbrough, J. He, I. McHardy, M. H. Anderson, and W. Shi. 2006. Enhancement of antimicrobial activity against *Pseudomonas aeruginosa* by coadministration of G10KHc and tobramycin. Antimicrob Agents Chemother 50:3833-8.
6. Eckert, R., J. He, D. K. Yarbrough, F. Qi, M. H. Anderson, and W. Shi. 2006. Targeted killing of *Streptococcus mutans* by a pheromone-guided "smart" antimicrobial peptide. Antimicrob Agents Chemother. 50:3651-3657.
7. Eckert, R., F. Qi, D. K. Yarbrough, J. He, M. H. Anderson, and W. Shi. 2006. Adding selectivity to antimicrobial peptides: rational design of a multidomain peptide against *Pseudomonas* spp. Antimicrob Agents Chemother 50:1480-8.
8. Fauchere, J. L., and V. Pliska. 1983. Hydrophobic parameters-pi of amino-acid side-chains from the partitioning of N-acetyl-amino-acid amides. Eur J Med Chem 18:369-375.
9. He, J., M. H. Anderson, W. Shi, and R. Eckert. 2009. Design and activity of a 'dual-targeted' antimicrobial peptide. Int J Antimicrob Agents. doi:10.1016/j.ijantimicag.2008.11.013.
10. He, J., R. Eckert, T. Pharm, M. D. Simanian, C. Hu, D. K. Yarbrough, F. Qi, M. H. Anderson, and W. Shi. 2007. Novel synthetic antimicrobial peptides against *Streptococcus mutans*. Antimicrob Agents Chemother 51:1351-8.
11. Isturiz, R. 2008. Global resistance trends and the potential impact on empirical therapy. Int J Antimicrob Agents 32 Suppl 4:S201-6.
12. Lopez, A. D., C. D. Mathers, M. Ezzati, D. T. Jamison, and C. J. Murray. 2006. Global and regional burden of disease and risk factors, 2001: systematic analysis of population health data. Lancet 367:1747-57.
13. Mokdad, A. H., J. S. Marks, D. F. Stroup, and J. L. Gerberding. 2004. Actual causes of death in the United States, 2000. JAMA 291:1238-45.
14. Patrzykat, A., C. L. Friedrich, L. Zhang, V. Mendoza, and R. E. Hancock. 2002. Sublethal concentrations of pleurocidin-derived antimicrobial peptides inhibit macromolecular synthesis in *Escherichia coli*. Antimicrob Agents Chemother 46:605-14.
15. Qi, F., J. Kreth, C. M. Levesque, O. Kay, R. W. Mair, W. Shi, D. G. Cvitkovitch, and S. D. Goodman. 2005. Peptide pheromone induced cell death of *Streptococcus mutans*. FEMS Microbiol Lett 251:321-6.
16. Ruby, J., and M. Goldner. 2007. Nature of symbiosis in oral disease. J Dent Res 86:8-11.
17. Strom, M. S., and S. Lory. 1986. Cloning and expression of the pilin gene of *Pseudomonas aeruginosa* PAK in *Escherichia coli*. J Bacteriol 165:367-72.
18. ten Cate, J. M. 2006. Biofilms, a new approach to the microbiology of dental plaque. Odontology 94:1-9.
19. Tincu, J. A., L. P. Menzel, R. Azimov, J. Sands, T. Hong, A. J. Waring, S. W. Taylor, and R. I. Lehrer. 2003. Plicatamide, an antimicrobial octapeptide from *Styela plicata* hemocytes. J Biol Chem 278:13546-53.
20. Zinder, N. D., V. Lederberg. 1952. Genetic exchange in *Salmonella*. Journal of Bacteriology 64:679-699.

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

SEQUENCE LISTING (2030 sequences)

SEQ ID NO: 1 - protein, 8 aa, Homo sapiens
  angiotensin II
DRVYIHPF

SEQ ID NO: 2 - protein, 8 aa, Artificial Sequence
  synthetic peptide corresponding to SEQ ID NO:1
  MOD_RES (3)...(3): Xaa = N-(prop-2-yl)glycine
  MOD_RES (5)...(5): Xaa = N-(1-methylprop-1-yl)glycine
DRXYXHPF

SEQ ID NO: 3 - protein, 9 aa, Homo sapiens
  bradykinin
RPPGFSPFR

SEQ ID NO: 4 - protein, 9 aa, Artificial Sequence
  synthetic peptide corresponding to SEQ ID NO:3
  MOD_RES (5)...(5): Xaa = N-benzylglycine
  MOD_RES (6)...(6): Xaa = N-(2-hydroxyethyl)glycine
  MOD_RES (8)...(8): Xaa = N-benzylglycine
RPPGXXPXR

SEQ ID NO: 5 - protein, 15 aa, Homo sapiens
  beta-endorphin
GGFMTSEKSQTPLVT

SEQ ID NO: 6 - protein, 15 aa, Artificial Sequence
  synthetic peptide corresponding to SEQ ID NO:5
  MOD_RES (3)...(3): Xaa = N-benzylglycine
  MOD_RES (5)...(5): Xaa = N-(2-hydroxyethyl)glycine
  MOD_RES (8)...(8): Xaa = N-(aminoalkyl)glycine
  MOD_RES (11)...(11): Xaa = N-(2-hydroxyethyl)glycine
  MOD_RES (14)...(14): Xaa = N-(prop-2-yl)glycine
GGXMXSEXSQXPLXT

SEQ ID NO: 7 - protein, 7 aa, Artificial Sequence
  synthetic new linker G-7
GGGGGGG

SEQ ID NO: 8 - protein, 3 aa, Artificial Sequence
  synthetic new linker L10
AGA

SEQ ID NO: 9 - protein, 5 aa, Artificial Sequence
  synthetic new linker L11
GAGAG

SEQ ID NO: 10 - protein, 39 aa, Artificial Sequence
  synthetic retro form of peptide Smu11
KSKQRSIEERLAQNKKALEELKEDSYTLFKEVTEILNKM

SEQ ID NO: 11 - protein, 39 aa, Artificial Sequence
  synthetic antimicrobial and/or tartgeting peptide Smu11
MKNLIETVEKFLTYSDEKLEELAKKNQALREEISRQKSK

SEQ ID NO: 12 - protein, 20 aa, Artificial Sequence
  synthetic antimicrobial and/or tartgeting peptide Smu.18
GGRAGRIKKLSQKEAEPFEN

SEQ ID NO: 13 - protein, 33 aa, Artificial Sequence
  synthetic antimicrobial and/or tartgeting peptide Smu41
MFIRSKLRRVDFSGVRRGNKHFLLDKLLITLVK

SEQ ID NO: 14 - protein, 25 aa, Artificial Sequence
  synthetic antimicrobial and/or tartgeting peptide Smu68
MSALFYDTLAAIWISIAGVDARWGH

SEQ ID NO: 15 - protein, 46 aa, Artificial Sequence
  synthetic antimicrobial and/or tartgeting peptide Smu150
GGKVSGGEAVAAIGICATASAAIGGLAGATLVTPYCVGTWGLIRSH

SEQ ID NO: 16 - protein, 49 aa, Artificial Sequence
  synthetic antimicrobial and/or tartgeting peptide Smu151
DKQAADTFLSAVGGAASGFTYCASNGVWHPYILAGCAGVGAVGSVVFPH

SEQ ID NO: 17 - protein, 26 aa, Artificial Sequence
  synthetic antimicrobial and/or tartgeting peptide Smu223c
GGKYLFLASKTKEYFKSHFREIMIDV

SEQ ID NO: 18 - protein, 37 aa, Artificial Sequence
  synthetic antimicrobial and/or tartgeting peptide Smu225c
MFISFVDCIQNIEKIEKELLKIGITDIQINQDAGWLY

SEQ ID NO: 19 - protein, 71 aa, Artificial Sequence
  synthetic antimicrobial and/or tartgeting peptide Smu277
YLTEIEGEGLGLGICLGLVGFAGGFAHGVVQGAGVGTAIEPGYGTIIGALVDGVGQDLIYGGAGFAAGYSL

SEQ ID NO: 20 - protein, 51 aa, Artificial Sequence
  synthetic antimicrobial and/or tartgeting peptide Smu283
GGFDVKGVAASYLAMGTAALGGLACTTPVGAVLYLGAEVCAGAAVIYYGAN

SEQ ID NO: 21 - protein, 51 aa, Artificial Sequence
  synthetic antimicrobial and/or tartgeting peptide Smu299c
GGGLYDGANGYAYRDSQGHWAYKVTKTPAQALTDVVVNSWASGAASFAAYA

SEQ ID NO: 22 - protein, 28 aa, Artificial Sequence
  synthetic antimicrobial and/or tartgeting peptide Smu390
GGRSSYNGFSKICFLKIEHFGSYSYQGR

SEQ ID NO: 23 - protein, 55 aa, Artificial Sequence
  synthetic antimicrobial and/or tartgeting peptide Smu423
GGGMIRCALGTAGSAGLGFVGGMGAGTVTLPVVGTVSGAALGGWSGAAVGAATFC

SEQ ID NO: 24 - protein, 67 aa, Artificial Sequence
  synthetic antimicrobial and/or tartgeting peptide Smu427
MEKTYHIDGLKCQGCADNVTKRFSELKKVNDVKVDLDKKEVRITGNPSKWSLKRALKGTNYELGAEI

SEQ ID NO: 25 - protein, 35 aa, Artificial Sequence
  synthetic antimicrobial and/or tartgeting peptide Smu444
MSVGMGVIERGSFDFSASAILQKRETKCLKNKPFT

SEQ ID NO: 26 - protein, 34 aa, Artificial Sequence
  synthetic antimicrobial and/or tartgeting peptide Smu451
MKMRAGQVVFIYKLILVLLFYVLQKLFDLKKGCF

SEQ ID NO: 27 - protein, 37 aa, Artificial Sequence
  synthetic antimicrobial and/or tartgeting peptide Smu529
MLPDSALDERIKGRVSAKNSSLLSALIKKLALIIFIG

SEQ ID NO: 28 - protein, 47 aa, Artificial Sequence
  synthetic antimicrobial and/or tartgeting peptide Smu616
GGVATYGAATMGLCAVSGPIGWGLGGAYLLTCAAAGGMIGYGAATLD

SEQ ID NO: 29 - protein, 35 aa, Artificial Sequence
  synthetic antimicrobial and/or tartgeting peptide Smu750c
MLSNVLSRSVVSPNVDIPNSMVILSPLLISISNYH

SEQ ID NO: 30 - protein, 37 aa, Artificial Sequence
  synthetic antimicrobial and/or tartgeting peptide Smu812
MAILTFFMALLFTYLKEKAQILYWPLFLHLMFYFVTA

SEQ ID NO: 31 - protein, 42 aa, Artificial Sequence
  synthetic antimicrobial and/or tartgeting peptide Smu1018
MNTNDLLQAFELMGLGMAGVFIVLGILYIVAELLIKIFPVNN

SEQ ID NO: 32 - protein, 35 aa, Artificial Sequence
  synthetic antimicrobial and/or tartgeting peptide Smu1047c
MVHLFSFVKLIYYDIMKYSIEEKVFFESPVGEIIQ

SEQ ID NO: 33 - protein, 64 aa, Artificial Sequence
  synthetic antimicrobial and/or tartgeting peptide Smu1131c
GGYATAKLTQTKPTMPKNVKKGTPPKGAPEDTPPNGNSNDSSQSDSDSDSNSSNTNSNSSITNG

SEQ ID NO: 34 - protein, 31 aa, Artificial Sequence
  synthetic antimicrobial and/or tartgeting peptide Smu1231c
MDKKRVIERIKSFSLRDEVIHFGELCIYWGK

SEQ ID NO: 35 - protein, 58 aa, Artificial Sequence
  synthetic antimicrobial and/or tartgeting peptide Smu1232c
GGKNKLVMSDLRQQVTDMGFVNVKTYINSGNLFFQSDCPRANISSRFEQFFADHYPFV

SEQ ID NO: 36 - protein, 33 aa, Artificial Sequence
  synthetic antimicrobial and/or tartgeting peptide Smu1358
MNNAYRWFFRLTLADNMHRFTTYGKEWQLSFPK

SEQ ID NO: 37 - protein, 36 aa, Artificial Sequence
  synthetic antimicrobial and/or tartgeting peptide Smu1359
MKLAGIEKKINLSKRRKLYLENSSLLINYVKVNMSY

SEQ ID NO: 38 - protein, 39 aa, Artificial Sequence
  synthetic antimicrobial and/or tartgeting peptide Smu1368
MTEILNFLIAVHDDRKNWKIKHCLSNSSFDFLCSPDSSR

SEQ ID NO: 39 - protein, 40 aa, Artificial Sequence
  synthetic antimicrobial and/or tartgeting peptide Smu1369
MPVQKALHVVSAYATDLGICYDQVVTVMIREVKTQLYQIY

SEQ ID NO: 40 - protein, 47 aa, Artificial Sequence
  synthetic antimicrobial and/or tartgeting peptide Smu1372c
GGSYQQVYSWVRKFKKDGINGLLDRRGKGLESKLISVVMVAIVLRPV

SEQ ID NO: 41 - protein, 32 aa, Artificial Sequence
  synthetic antimicrobial and/or tartgeting peptide Smu1504c
GGMSSGWLSDDFWLKSAIPLLKKRLAKWNETL

SEQ ID NO: 42 - protein, 39 aa, Artificial Sequence
  synthetic antimicrobial and/or tartgeting peptide Smu1505c
MAYSLTFQNPNDNLTDEEVAKYMEKITKALTEKIGAEVR

SEQ ID NO: 43 - protein, 82 aa, Artificial Sequence
  synthetic antimicrobial and/or tartgeting peptide Smu1719c
MNTFLWILLVIIALLAGLVGGTFIARKQMEKYLEENPPLNEDVIRNMMSQMGQKPSEAKVQQVVRQMNKQQKAAKAKAKKKK

SEQ ID NO: 44 - protein, 36 aa, Artificial Sequence
  synthetic antimicrobial and/or tartgeting peptide Smu1750c
MIFNRRKFFQYFGLSKEAMVEHIQPFILDIWQIHLF

SEQ ID NO: 45 - protein, 14 aa, Artificial Sequence
  synthetic antimicrobial and/or tartgeting peptide Smu1752c
GGWLNAISLYGRIG

SEQ ID NO: 46 - protein, 55 aa, Artificial Sequence
  synthetic antimicrobial and/or tartgeting peptide Smu1768c
GGHKQLVIEPLVSQNDQLSLIESLSGILSDSETVDVKDYRSERKEERLKKYESLT

SEQ ID NO: 47 - protein, 31 aa, Artificial Sequence
  synthetic antimicrobial and/or tartgeting peptide Smu1808c
MTTTQKTYLHIIRELENQDIDLIMRSLTSLT

SEQ ID NO: 48 - protein, 36 aa, Artificial Sequence
  synthetic antimicrobial and/or tartgeting peptide Smu1813
MPMTYCGSPRRTDLAVITDEELGQTLEVINHWPRNV

SEQ ID NO: 49 - protein, 96 aa, Artificial Sequence
  synthetic antimicrobial and/or tartgeting peptide Smu1882c
GGATDGEIIANRMLQGKATKGEITMYTWNIIQNGWVNSLVSWGIGGYNSSIGYSAQGNRGFSNYPYDVSMDSDNSSSSSNTTGGYVNYNQSFNSGW

SEQ ID NO: 50 - protein, 49 aa, Artificial Sequence
  synthetic antimicrobial and/or tartgeting peptide Smu1889c
GGLAGAGTGAAVSAPAAEGGGLGPIAGAAIGWDLGAISGAGLGWANFCQ

SEQ ID NO: 51 - protein, 32 aa, Artificial Sequence
  synthetic antimicrobial and/or tartgeting peptide Smu1895c
GGMTWAEIGAIVGATIGSFYIPNPVIVPFRVR

SEQ ID NO: 52 - protein, 62 aa, Artificial Sequence
  synthetic antimicrobial and/or tartgeting peptide Smu1896c
GGFGWDSIWRGFKCVAGTAGTIGTGALGGSATGGLTLPIIGHVSGGIIGGISGAGVGIASFC

SEQ ID NO: 53 - protein, 41 aa, Artificial Sequence
  synthetic antimicrobial and/or tartgeting peptide Smu1899
MLSISQRTDRVIVMDKGKIIEEGTHSELIAANGFYHHLFNK

SEQ ID NO: 54 - protein, 27 aa, Artificial Sequence
  synthetic antimicrobial and/or tartgeting peptide Smu1902c
GGAFYQRKENVISLDPREWLGFNVTEK

SEQ ID NO: 55 - protein, 10 aa, Artificial Sequence
  synthetic antimicrobial and/or tartgeting peptide Smu1903c
GGNIFEYFLE

SEQ ID NO: 56 - protein, 42 aa, Artificial Sequence
  synthetic antimicrobial and/or tartgeting peptide Smu1905c
GGGRAPRCAALVGASIYDGLAVVGDPVGVAMAAGTIAAGSFC

SEQ ID NO: 57 - protein, 48 aa, Artificial Sequence
  synthetic antimicrobial and/or tartgeting peptide Smu1906c
GGCSWKGADKAGFSGGVGGLIGAGGNPVGGVLGIAGGLDAYGELVGGN

SEQ ID NO: 58 - protein, 43 aa, Artificial Sequence
  synthetic antimicrobial and/or tartgeting peptide Smu1907
MEQNILNGSYFVLNGKNAKFLLEIDKLTLPDKLATLPVPHQVR

SEQ ID NO: 59 - protein, 55 aa, Artificial Sequence
  synthetic antimicrobial and/or tartgeting peptide Smu1914c
GGGRGWNCAAGIALGAGQGYMATAGGTAFLGPYAIGTGAFGAIAGGIGGALNSCG

SEQ ID NO: 60 - protein, 23 aa, Artificial Sequence
  synthetic antimicrobial and/or tartgeting peptide Smu1915
GGSGSLSTFFRLFNRSFTQALGK

SEQ ID NO: 61 - protein, 54 aa, Artificial Sequence
  synthetic antimicrobial and/or tartgeting peptide Smu1948
GGVFSVLKHTTWPTRKQSWHDFISILEYSAFFALVIFIFDKLLTLGLAELLKRF

SEQ ID NO: 62 - protein, 40 aa, Artificial Sequence
  synthetic antimicrobial and/or tartgeting peptide Smu1968c
GGSVLGKHALFILLKAGFKAYELAGAFEGWKGMHLPTEKC

SEQ ID NO: 63 - protein, 33 aa, Artificial Sequence
  synthetic antimicrobial and/or tartgeting peptide Smu1972c
GGLVMNDETIYLFTYENGQISYEEDKRDCSKNV

SEQ ID NO: 64 - protein, 41 aa, Artificial Sequence
  synthetic antimicrobial and/or tartgeting peptide Smu2105
MRFLKDELSVSVRLQEKSIEALPFRTKIEIEIESDNQIKTL

SEQ ID NO: 65 - protein, 41 aa, Artificial Sequence
  synthetic antimicrobial and/or tartgeting peptide Smu2106c
GGASGEKILEKLIHERKCQLTQNRQIVLKTDLNNLMKDFYK

SEQ ID NO: 66 - protein, 50 aa, Artificial Sequence
  synthetic antimicrobial and/or tartgeting peptide Smu2121c
GGIILAKAADLAEIERIISEDPFKINEIANYDIIEFCPTKSSKAFEKVLK

SEQ ID NO: 67 - protein, 12 aa, Artificial Sequence
  synthetic novel tartgeting peptide IT-1
YVNYNQSFNSGW

SEQ ID NO: 68 - protein, 8 aa, Artificial Sequence
  synthetic novel tartgeting peptide IT-2
NIFEYFLE

SEQ ID NO: 69 - protein, 18 aa, Artificial Sequence
  synthetic novel tartgeting peptide IT-3
VLGIAGGLDAYGELVGGN

SEQ ID NO: 70 - protein, 11 aa, Artificial Sequence
  synthetic novel tartgeting peptide IT-4
LDAYGELVGGN

SEQ ID NO: 71 - protein, 28 aa, Artificial Sequence
  synthetic novel tartgeting peptide IT-5
LGPIAGAAIGWDLGAISGAGLGWANFCQ

SEQ ID NO: 72 - protein, 15 aa, Artificial Sequence
  synthetic novel tartgeting peptide IT-6
KFINGVLSQFVLERK

SEQ ID NO: 73 - protein, 20 aa, Artificial Sequence
  synthetic novel tartgeting peptide IT-7
SQRIIEPVKSPQPYPGFSVS

SEQ ID NO: 74 - protein, 22 aa, Artificial Sequence
  synthetic novel tartgeting peptide IT-8
FSVAACGEQRAVTFVLLIEDLI

SEQ ID NO: 75 - protein, 29 aa, Artificial Sequence
  synthetic novel tartgeting peptide IT-9
WAWAESPRCVSTRSNIHALAFRVEVAALT

SEQ ID NO: 76 - protein, 12 aa, Artificial Sequence
  synthetic novel tartgeting peptide IT-10
SPAGLPGDGDEA

SEQ ID NO: 77 - protein, 4 aa, Artificial Sequence
  synthetic novel tartgeting peptide IT-11
RISE

SEQ ID NO: 78 - protein, 22 aa, Artificial Sequence
  synthetic novel tartgeting peptide IT-12
FGNIFKGLKDVIETIVKWTAAK

SEQ ID NO: 79 - protein, 20 aa, Artificial Sequence
  synthetic novel tartgeting peptide IT-13
FRSPCINNNSLQPPGVYPAR

SEQ ID NO: 80 - protein, 12 aa, Artificial Sequence
  synthetic novel tartgeting peptide IT-14
ALAGLAGLISGK

SEQ ID NO: 81 - protein, 9 aa, Artificial Sequence
  synthetic novel tartgeting peptide IT-15
DVILRVEAQ

SEQ ID NO: 82 - protein, 4 aa, Artificial Sequence
  synthetic novel tartgeting peptide IT-16
IDMR

SEQ ID NO: 83 - protein, 8 aa, Artificial Sequence
  synthetic novel tartgeting peptide IT-17
NNAIVYIS

SEQ ID NO: 84 - protein, 9 aa, Artificial Sequence
  synthetic novel tartgeting peptide IT-18
YSKTLHFAD

SEQ ID NO: 85 - protein, 12 aa, Artificial Sequence
  synthetic novel tartgeting peptide IT-19
PGAFRNPQMPRG

SEQ ID NO: 86 - protein, 20 aa, Artificial Sequence
  synthetic novel tartgeting peptide IT-20
PALVDLSNKEAVWAVLDDHS

SEQ ID NO: 87 - protein, 30 aa, Artificial Sequence
  synthetic novel tartgeting peptide IT-21
YVEEAVRAALKKEARISTEDTPVNLPSFDC

SEQ ID NO: 88 - protein, 22 aa, Artificial Sequence
  synthetic novel tartgeting peptide IT-22
VPLDDGTRRPEVARNRDKDRED

SEQ ID NO: 89 - protein, 20 aa, Artificial Sequence
  synthetic novel tartgeting peptide IT-23
PALVDLSNKEAVWAVLDDHS

SEQ ID NO: 90 - protein, 19 aa, Artificial Sequence
  synthetic novel tartgeting peptide IT-24
EEAEEKLAEVSQAVKRLVR

SEQ ID NO: 91 - protein, 26 aa, Artificial Sequence
  synthetic novel tartgeting peptide IT-25
VGLDVSVLVLFFGLQLLSVLLGAMIR

SEQ ID NO: 92 - protein, 38 aa, Artificial Sequence
  synthetic novel tartgeting peptide IT-26
LTILPTTFFAIIVPILAVAFIAYSGFKIKGIVEHKDQW

SEQ ID NO: 93 - protein, 27 aa, Artificial Sequence
  synthetic novel tartgeting peptide IT-27
ALFVSLEQFLVVVAKSVFALCHSGTLS

SEQ ID NO: 94 - protein, 25 aa, Artificial Sequence
  synthetic novel tartgeting peptide IT-28
VSRDEAMEFIDREWTTLQPAGKSHA

SEQ ID NO: 95 - protein, 32 aa, Artificial Sequence
  synthetic novel tartgeting peptide IT-29
GSVIKKRRKRMSKKKHRKMLRRTRVQRRKLGK

SEQ ID NO: 96 - protein, 27 aa, Artificial Sequence
  synthetic novel tartgeting peptide IT-30
GKAKPYQVRQVLRAVDKLETRRKKGGR

SEQ ID NO: 97 - protein, 18 aa, Artificial Sequence
  synthetic novel tartgeting peptide IT-31
NATGTDIGEVTLTLGRFS

SEQ ID NO: 98 - protein, 20 aa, Artificial Sequence
  synthetic novel tartgeting peptide IT-32
VSFLAGWLCLGLAAWRLGNA

SEQ ID NO: 99 - protein, 37 aa, Artificial Sequence
  synthetic novel tartgeting peptide IT-33
VRTLTILVIFIFNYLKSISYKLKQPFENNLAQSMISI

SEQ ID NO: 100 - protein, 27 aa, Artificial Sequence
  synthetic novel tartgeting peptide IT-34
AFWLNILLTLLGYIPGIVHAVYIIAKR

SEQ ID NO: 101 - protein, 36 aa, Artificial Sequence
  synthetic novel tartgeting peptide IT-35
EICLTLVFPIRGSYSEAAKFPVPIHIVEDGTVELPK

SEQ ID NO: 102 - protein, 20 aa, Artificial Sequence
  synthetic novel tartgeting peptide IT-36
VYRHLRFIDGKLVEIRLERK

SEQ ID NO: 103 - protein, 22 aa, Artificial Sequence
  synthetic novel tartgeting peptide IT-37
YIVGALVILAVAGLIYSMLRKA

SEQ ID NO: 104 - protein, 18 aa, Artificial Sequence
  synthetic novel tartgeting peptide IT-38
VMFVLTRGRSPRPMIPAY

SEQ ID NO: 105 - protein, 19 aa, Artificial Sequence
  synthetic novel tartgeting peptide IT-39
FGFCVWMYQLLAGPPGPPA

SEQ ID NO: 106 - protein, 14 aa, Artificial Sequence
  synthetic novel tartgeting peptide IT-40
QRVSLWSEVEHEFR

SEQ ID NO: 107 - protein, 23 aa, Artificial Sequence
  synthetic novel tartgeting peptide IT-41
KRGSKIVIAIAVVLIVLAGVWVW

SEQ ID NO: 108 - protein, 28 aa, Artificial Sequence
  synthetic novel tartgeting peptide IT-42
TVLDWLSLALATGLFVYLLVALLRADRA

SEQ ID NO: 109 - protein, 18 aa, Artificial Sequence
  synthetic novel tartgeting peptide IT-43
DRCLSVLSWSPPKVSPLI

SEQ ID NO: 110 - protein, 17 aa, Artificial Sequence
  synthetic novel tartgeting peptide IT-44
DPALADFAAGMRAQVRT

SEQ ID NO: 111 - protein, 22 aa, Artificial Sequence
  synthetic novel tartgeting peptide IT-45
WTKPSFTDLRLGFEVTLYFANR

SEQ ID NO: 112 - protein, 17 aa, Artificial Sequence
  synthetic novel tartgeting peptide IT-46
FSFKQRVMFRKEVERLR

SEQ ID NO: 113 - protein, 15 aa, Artificial Sequence
  synthetic novel tartgeting peptide IT-47
VIKISVPGQVQMLIP

SEQ ID NO: 114 - protein, 26 aa, Artificial Sequence
  synthetic novel tartgeting peptide IT-48
KLQVHHGRATHTLLLQPPLCAPGTIR

SEQ ID NO: 115 - protein, 25 aa, Artificial Sequence
  synthetic novel tartgeting peptide IT-49
SLVRIHDQQPWVTRGAFIDAARTCS

SEQ ID NO: 116 - protein, 17 aa, Artificial Sequence
  synthetic novel tartgeting peptide IT-50
HSDEPIPNILFKSDSVH

SEQ ID NO: 117 - protein, 22 aa, Artificial Sequence
  synthetic novel tartgeting peptide IT-51
GKPKRMPAEFIDGYGQALLAGA

SEQ ID NO: 118 - protein, 20 aa, Artificial Sequence
  synthetic novel tartgeting peptide IT-52
DEYPAKLPLSDKGATEPRRH

SEQ ID NO: 119 - protein, 26 aa, Artificial Sequence
  synthetic novel tartgeting peptide IT-53
SDILAEMFEKGELQTLVKDAAAKANA

SEQ ID NO: 120 - protein, 12 aa, Artificial Sequence
  synthetic novel tartgeting peptide IT-54
RWVSCNPSWRIQ

SEQ ID NO: 121 - protein, 25 aa, Artificial Sequence
  synthetic novel tartgeting peptide IT-55
NHKTLKEWKAKWGPEAVESWATLLG

SEQ ID NO: 122 - protein, 14 aa, Artificial Sequence
  synthetic novel tartgeting peptide IT-56
LALIGAGIWMIRKG

SEQ ID NO: 123 - protein, 24 aa, Artificial Sequence
  synthetic novel tartgeting peptide IT-57
RLEYRRLETQVEENPESGRRPMRG

SEQ ID NO: 124 - protein, 19 aa, Artificial Sequence
  synthetic novel tartgeting peptide IT-58
CDDLHALERAGKLDALLSA

SEQ ID NO: 125 - protein, 25 aa, Artificial Sequence
  synthetic novel tartgeting peptide IT-59
AVGNNLGKDNDSGHRGKKHRKHKHR

SEQ ID NO: 126 - protein, 22 aa, Artificial Sequence
  synthetic novel tartgeting peptide IT-60
YLTSLGLDAAEQAQGLLTILKG

SEQ ID NO: 127 - protein, 24 aa, Artificial Sequence
  synthetic novel tartgeting peptide IT-61
HATLLPAVREAISRQLLPALVPRG

SEQ ID NO: 128 - protein, 21 aa, Artificial Sequence
  synthetic novel tartgeting peptide IT-62
GCKGCAQRDPCAEPEPYFRLR

SEQ ID NO: 129 - protein, 22 aa, Artificial Sequence
  synthetic novel tartgeting peptide IT-63
EPLILKELVRNLFLFCYARALR

SEQ ID NO: 130 - protein, 21 aa, Artificial Sequence
  synthetic novel tartgeting peptide IT-64
QTVHHIHMHVLGQRQMHWPPG

SEQ ID NO: 131 - protein, 27 aa, Artificial Sequence
  synthetic novel tartgeting peptide IT-65
HARAAVGVAELPRGAAVEVELIAAVRP

SEQ ID NO: 132 - protein, 27 aa, Artificial Sequence
  synthetic novel tartgeting peptide IT-66
DTDCLSRAYAQRIDELDKQYAGIDKPL

SEQ ID NO: 133 - protein, 24 aa, Artificial Sequence
  synthetic novel tartgeting peptide IT-67
GQRQRLTCGRVSGCSEGPSREAAR

SEQ ID NO: 134 - protein, 11 aa, Artificial Sequence
  synthetic novel tartgeting peptide IT-68
GGTKEIVYQRG

SEQ ID NO: 135 - protein, 12 aa, Artificial Sequence
  synthetic novel tartgeting peptide IT-69
ILSQEADRKKLF

SEQ ID NO: 136 - protein, 15 aa, Artificial Sequence
  synthetic novel tartgeting peptide IT-70
NRQAQGERAHGEQQG

SEQ ID NO: 137 - protein, 13 aa, Artificial Sequence
  synthetic novel tartgeting peptide IT-71
KIDTNQWPPNKEG

SEQ ID NO: 138 - protein, 11 aa, Artificial Sequence
  synthetic novel tartgeting peptide IT-72
EPTDGVACKER

SEQ ID NO: 139 - protein, 27 aa, Artificial Sequence
  synthetic novel tartgeting peptide IT-73
GWWEELLHETILSKFKITKALELPIQL

SEQ ID NO: 140 - protein, 26 aa, Artificial Sequence
  synthetic novel tartgeting peptide IT-74
DIDWGRKISCAAGVAYGAIDGCATTV

SEQ ID NO: 141 - protein, 23 aa, Artificial Sequence
  synthetic novel tartgeting peptide IT-75
GVARGLQLGIKTRTQWGAATGAA

SEQ ID NO: 142 - protein, 17 aa, Artificial Sequence
  synthetic novel tartgeting peptide IT-76
EMRLSKFFRDFILWRKK

SEQ ID NO: 143 - protein, 17 aa, Artificial Sequence
  synthetic novel tartgeting peptide IT-77
EMRISRIILDFLFLRKK

SEQ ID NO: 144 - protein, 28 aa, Artificial Sequence
  synthetic novel tartgeting peptide IT-78
FFKTIFVLILGALGVAAGLYIEKNYIDK

SEQ ID NO: 145 - protein, 28 aa, Artificial Sequence
  synthetic novel tartgeting peptide IT-79
FGTPWSITNFWKKNFNDRPDFDSDRRRY

SEQ ID NO: 146 - protein, 13 aa, Artificial Sequence
  synthetic novel tartgeting peptide IT-80
GGNLGPGFGVIIP

SEQ ID NO: 147 - protein, 19 aa, Artificial Sequence
  synthetic novel tartgeting peptide IT-81
AIATGLDIVDGKFDGYLWA

SEQ ID NO: 148 - protein, 28 aa, Artificial Sequence
  synthetic novel tartgeting peptide IT-82
FGVGVGIALFMAGYAIGKDLRKKFGKSC

SEQ ID NO: 149 - protein, 31 aa, Artificial Sequence
  synthetic novel tartgeting peptide IT-83
QKPRKNETFIGYIQRYDIDGNGYQSLPCPQN

SEQ ID NO: 150 - protein, 32 aa, Artificial Sequence
  synthetic novel tartgeting peptide IT-84
FRKKRYGLSILLWLNAFTNLVNSIHAFYMTLF

SEQ ID NO: 151 - protein, 24 aa, Artificial Sequence
  synthetic novel tartgeting peptide IT-85
VMASLTWRMRAASASLPTHSRTDA

SEQ ID NO: 152 - protein, 19 aa, Artificial Sequence
  synthetic novel tartgeting peptide IT-86
HRKNPVLGVGRRHRAHNVA

SEQ ID NO: 153 - protein, 13 aa, Artificial Sequence
  synthetic novel tartgeting peptide IT-87
EAVGQDLVDAHHP

SEQ ID NO: 154 - protein, 24 aa, Artificial Sequence
  synthetic novel tartgeting peptide IT-88
GRLVLEITADEVKALGEALANAKI

SEQ ID NO: 155 - protein, 23 aa, Artificial Sequence
  synthetic novel tartgeting peptide IT-89
HEDDKRRGMSVEVLGFEVVQHEE

SEQ ID NO: 156 - protein, 8 aa, Artificial Sequence
  synthetic novel tartgeting peptide IT-90
RNVIGQVL

SEQ ID NO: 157 - protein, 27 aa, Artificial Sequence
  synthetic novel tartgeting peptide IT-91
TSVRPGAAGAAVPAGAAGAAGAGWRWP

SEQ ID NO: 158 - protein, 19 aa, Artificial Sequence
  synthetic novel tartgeting peptide IT-92
GQDEGQRRAGVGEGQGVDG

SEQ ID NO: 159 - protein, 8 aa, Artificial Sequence
  synthetic novel tartgeting peptide IT-93
AMRSVNQA

SEQ ID NO: 160 - protein, 18 aa, Artificial Sequence
  synthetic novel tartgeting peptide IT-94
DQVAHSGDMLVQARRRDS

SEQ ID NO: 161 - protein, 27 aa, Artificial Sequence
  synthetic novel tartgeting peptide IT-95
GHLLRVGGRVGGVGGVAGACAQPFGGQ

SEQ ID NO: 162 - protein, 12 aa, Artificial Sequence
  synthetic novel tartgeting peptide IT-96
VAGACAQPFGGQ

SEQ ID NO: 163 - protein, 32 aa, Artificial Sequence
  synthetic novel tartgeting peptide IT-97
GVAERNLDRITVAVAIIWTITIVGLGLVAKLG

SEQ ID NO: 164 - protein, 32 aa, Artificial Sequence
  synthetic novel tartgeting peptide IT-98
VRSAKAVKALTAAGYTGELVNVSGGMKAWLGQ

SEQ ID NO: 165 - protein, 7 aa, Artificial Sequence
  synthetic novel tartgeting peptide IT-99
MKAWLGQ

SEQ ID NO: 166 - protein, 37 aa, Artificial Sequence
  synthetic novel tartgeting peptide IT-100
LDPLEPRIAPPGDRSHQGAPACHRDPLRGRSARDAER

SEQ ID NO: 167 - protein, 29 aa, Artificial Sequence
  synthetic novel tartgeting peptide IT-101
RLRVGRATDLPLTSFAVGVVRNLPDAPAH

SEQ ID NO: 168 - protein, 30 aa, Artificial Sequence
  synthetic novel tartgeting peptide IT-102
WKRLWPARILAGHSRRRMRWMVVWRYFAAT

SEQ ID NO: 169 - protein, 22 aa, Artificial Sequence
  synthetic novel tartgeting peptide IT-103
AQFYEAIITGYALGAGQRIGQL

SEQ ID NO: 170 - protein, 24 aa, Artificial Sequence
  synthetic novel tartgeting peptide IT-104
RAVAAHLQGRHHGHQVRRQRHGQR

SEQ ID NO: 171 - protein, 19 aa, Artificial Sequence
  synthetic novel tartgeting peptide IT-105
GEGLPPPVLHLPPPRMSGR

SEQ ID NO: 172 - protein, 14 aa, Artificial Sequence
  synthetic novel tartgeting peptide IT-106
DALRRSRSQGRRHR

SEQ ID NO: 173 - protein, 17 aa, Artificial Sequence
  synthetic novel tartgeting peptide IT-107
SPVPRFTAVGGVSRGSP

SEQ ID NO: 174 - protein, 11 aa, Artificial Sequence
  synthetic novel tartgeting peptide IT-108
WGPLGPERPLW

SEQ ID NO: 175 - protein, 11 aa, Artificial Sequence
  synthetic novel tartgeting peptide IT-109
VTTNVRQGAGS

SEQ ID NO: 176 - protein, 14 aa, Artificial Sequence
  synthetic novel tartgeting peptide IT-110
LAAKTAVCVGRAFM

SEQ ID NO: 177 - protein, 26 aa, Artificial Sequence
  synthetic novel tartgeting peptide IT-111
GRLSRREEDPATSIILLRGAYRMAVF

SEQ ID NO: 178 - protein, 13 aa, Artificial Sequence
  synthetic novel tartgeting peptide IT-112
SDNDGKLILGTSQ

SEQ ID NO: 179 - protein, 36 aa, Artificial Sequence
  synthetic novel tartgeting peptide IT-113
HGAHQRTGQRLHHHRGRTVSGCRQNPVAGVDPDEHR

SEQ ID NO: 180 - protein, 23 aa, Artificial Sequence
  synthetic novel tartgeting peptide IT-114
RQAPGPGLVTITAACSAPGSRSR

SEQ ID NO: 181 - protein, 10 aa, Artificial Sequence
  synthetic novel tartgeting peptide IT-115
LLIERFSNHH

SEQ ID NO: 182 - protein, 9 aa, Artificial Sequence
  synthetic novel tartgeting peptide IT-116
MILHRRRDR

SEQ ID NO: 183 - protein, 20 aa, Artificial Sequence
  synthetic novel tartgeting peptide IT-117
GPGVVGPAPFSRLPAHALNL

SEQ ID NO: 184 - protein, 32 aa, Artificial Sequence
  synthetic novel tartgeting peptide IT-118
TASPPAPSDQGLRTAFPATLLIALAALARISR

SEQ ID NO: 185 - protein, 39 aa, Artificial Sequence
  synthetic novel tartgeting peptide IT-119
SPATQKAPTRAQPSRAPVQDCGDGRPTAAPDDVERLSPR

SEQ ID NO: 186 - protein, 20 aa, Artificial Sequence
  synthetic novel tartgeting peptide IT-120
DVRDRVDLAGADLCAAHATR

SEQ ID NO: 187 - protein, 28 aa, Artificial Sequence
  synthetic novel tartgeting peptide IT-121
FAKETGFGIGGAQEGWWIIADIYGPNPF

SEQ ID NO: 188 - protein, 23 aa, Artificial Sequence
  synthetic novel tartgeting peptide IT-122
GAIPDPVTHRVDWEEDHQTRPSR

SEQ ID NO: 189 - protein, 29 aa, Artificial Sequence
  synthetic novel tartgeting peptide IT-123
LVRRNAVAGRSDGLAGAEQLDLVRLQGVL

SEQ ID NO: 190 - protein, 9 aa, Artificial Sequence
  synthetic novel tartgeting peptide IT-124
LFDERNKIA

SEQ ID NO: 191 - protein, 18 aa, Artificial Sequence
  synthetic novel tartgeting peptide IT-125
DAITGGNPPLSDTDGLRP

SEQ ID NO: 192 - protein, 13 aa, Artificial Sequence
  synthetic novel tartgeting peptide IT-126
QGLARPVLRRIPL

SEQ ID NO: 193 - protein, 18 aa, Artificial Sequence
  synthetic novel tartgeting peptide IT-127
YDPVPKRKNKNSEGKREE

SEQ ID NO: 194 - protein, 17 aa, Artificial Sequence
  synthetic novel tartgeting peptide IT-128
SGSAIRMLEIATKMLKR

SEQ ID NO: 195 - protein, 19 aa, Artificial Sequence
  synthetic novel tartgeting peptide IT-129
YDKYIKYLSIQPPFIVYFI

SEQ ID NO: 196 - protein, 56 aa, Artificial Sequence
  synthetic novel tartgeting peptide IT-130
QKIIDMSKFLFSLILFIMIVVIYIGKSIGGYSAIVSSIMLELDTVLYNKKIFFIYK

SEQ ID NO: 197 - protein, 9 aa, Artificial Sequence
  synthetic novel tartgeting peptide IT-131
DEVWKMLGI

SEQ ID NO: 198 - protein, 39 aa, Artificial Sequence
  synthetic novel tartgeting peptide IT-132
YSKKLFEYFYFIIFILIRYLIFYKIIQNKNYYINNIAYN

SEQ ID NO: 199 - protein, 35 aa, Artificial Sequence
  synthetic novel tartgeting peptide IT-133
YFIKDDNEALSKDWEVIGNDLKGTIDKYGKEFKVR

SEQ ID NO: 200 - protein, 14 aa, Artificial Sequence
  synthetic novel tartgeting peptide IT-134
SRLVREIKKKCRKS

SEQ ID NO: 201 - protein, 24 aa, Artificial Sequence
  synthetic novel tartgeting peptide IT-135
FESLLPQATKKIVNNKGSKINKIF

SEQ ID NO: 202 - protein, 17 aa, Artificial Sequence
  synthetic novel tartgeting peptide IT-136
ELLTQIRLALLYSVNEW

SEQ ID NO: 203 - protein, 55 aa, Artificial Sequence
  synthetic novel tartgeting peptide IT-137
PLNFYRAVKENRLPLSEKNINDFTNIKLKVSPKLINLLQESSIFYNFSPKKRNTN

SEQ ID NO: 204 - protein, 42 aa, Artificial Sequence
  synthetic novel tartgeting peptide IT-138
YPNEYCIFLENLSLEELKEIKAINGETLNLEEIINERKNLKD

SEQ ID NO: 205 - protein, 39 aa, Artificial Sequence
  synthetic novel tartgeting peptide IT-139
AVAGAAVGALLGNDARSTAVGAAIGGALGAGAGELTKNK

SEQ ID NO: 206 - protein, 39 aa, Artificial Sequence
  synthetic novel tartgeting peptide IT-140
IKGTIAFVGEDYVEIRVDKGVKLTFRKSAIANVINNNQQ

SEQ ID NO: 207 - protein, 28 aa, Artificial Sequence
  synthetic novel tartgeting peptide IT-141
KKFIILLFILVQGLIFSATKTLSDIIAL

SEQ ID NO: 208 - protein, 16 aa, Artificial Sequence
  synthetic novel tartgeting peptide IT-142
FTQGIKRIVLKRLKED

SEQ ID NO: 209 - protein, 29 aa, Artificial Sequence
  synthetic novel tartgeting peptide IT-143
MPKRHYYKLEAKALQFGLPFAYSPIQLLK

SEQ ID NO: 210 - protein, 18 aa, Artificial Sequence
  synthetic novel tartgeting peptide IT-144
IIELHPKSWTQDWRCSFL

SEQ ID NO: 211 - protein, 39 aa, Artificial Sequence
  synthetic novel tartgeting peptide IT-145
VEAGKRNISLENIEKISKGLGISISELFKYIEEGEDKIG

SEQ ID NO: 212 - protein, 31 aa, Artificial Sequence
  synthetic novel tartgeting peptide IT-146
RNSADNQTKIDKIRIDISLWDEHLNIVKQGK

SEQ ID NO: 213 - protein, 30 aa, Artificial Sequence
  synthetic novel tartgeting peptide IT-147
GVENRRFYERDVSKVSMMTSEAVAPRGGSK

SEQ ID NO: 214 - protein, 22 aa, Artificial Sequence
  synthetic novel tartgeting peptide IT-148
IVELDDTTILERALSMLGEANA

SEQ ID NO: 215 - protein, 23 aa, Artificial Sequence
  synthetic novel tartgeting peptide IT-149
SVRAVKPIDETVARHFPGDFIVN

SEQ ID NO: 216 - protein, 32 aa, Artificial Sequence
  synthetic novel tartgeting peptide IT-150
YINRRLKKAFSDADIKEAPAEFYEELRRVQYV

SEQ ID NO: 217 - protein, 23 aa, Artificial Sequence
  synthetic novel tartgeting peptide IT-151
SVRAVKPIDEIVAWHFPGDFIVN

SEQ ID NO: 218 - protein, 29 aa, Artificial Sequence
  synthetic novel tartgeting peptide IT-152
YVSADESAYNHIVTDDIPLADRRIEAVQQ

SEQ ID NO: 219 - protein, 9 aa, Artificial Sequence
  synthetic novel tartgeting peptide IT-153
YIACPGYFY

SEQ ID NO: 220 - protein, 13 aa, Artificial Sequence
  synthetic novel tartgeting peptide IT-154
YFSFLEIVGMARR

SEQ ID NO: 221 - protein, 28 aa, Artificial Sequence
  synthetic novel tartgeting peptide IT-155
LKLAFGVYPFQAMSQSDTAVSERNVLWR

SEQ ID NO: 222 - protein, 29 aa, Artificial Sequence
  synthetic novel tartgeting peptide IT-156
GRFQISIRGEEKSKVKVQGKGTFTDRNTT

SEQ ID NO: 223 - protein, 30 aa, Artificial Sequence
  synthetic novel tartgeting peptide IT-157
RRFRKTTENREKSKNKKAVLGLSTTSTASY

SEQ ID NO: 224 - protein, 29 aa, Artificial Sequence
  synthetic novel tartgeting peptide IT-158
WENKPSPLGSIKKLQGLVYRLIGYRHFWV

SEQ ID NO: 225 - protein, 30 aa, Artificial Sequence
  synthetic novel tartgeting peptide IT-159
IFSLHHFALICSEMGTFAVSKRAKYKWEVL

SEQ ID NO: 226 - protein, 11 aa, Artificial Sequence
  synthetic novel tartgeting peptide IT-160
AQYKYINKLLN

SEQ ID NO: 227 - protein, 30 aa, Artificial Sequence
  synthetic novel tartgeting peptide IT-161
NKVLQVEVMWDGSVVGRPAGVISIKSSKKG

SEQ ID NO: 228 - protein, 28 aa, Artificial Sequence
  synthetic novel tartgeting peptide IT-162
QKAKEESDRKAAVSYNGFHRVNVVSIPK

SEQ ID NO: 229 - protein, 31 aa, Artificial Sequence
  synthetic novel tartgeting peptide IT-163
MENILIYIPMVLSPFGSGILLFLGKDRRYML

SEQ ID NO: 230 - protein, 29 aa, Artificial Sequence
  synthetic novel tartgeting peptide IT-164
KKSHSQGKRKLKDLNSAYKIDNQLHYALR

SEQ ID NO: 231 - protein, 23 aa, Artificial Sequence
  synthetic novel tartgeting peptide IT-165
CYDSFDFSIFVTFANRMKLSVGS

SEQ ID NO: 232 - protein, 17 aa, Artificial Sequence
  synthetic novel tartgeting peptide IT-166
AQSAGQIKRKSKVRIHV

SEQ ID NO: 233 - protein, 35 aa, Artificial Sequence
  synthetic novel tartgeting peptide IT-167
SRMSEHSPAGLVFEVGPMDKGSFIILDSYHPTVKK

SEQ ID NO: 234 - protein, 41 aa, Artificial Sequence
  synthetic novel tartgeting peptide IT-168
ELHRIMSTEKIGAVTKMNFDTAPIMSILPIDIYPKEVGIGS

SEQ ID NO: 235 - protein, 31 aa, Artificial Sequence
  synthetic novel tartgeting peptide IT-169
FARVRRLHQNRILTQPLTNLKYCLRQPIYSD

SEQ ID NO: 236 - protein, 30 aa, Artificial Sequence
  synthetic novel tartgeting peptide IT-170
AYGKVFSMDIMLSENDKLIVLRISHHSAWH

SEQ ID NO: 237 - protein, 23 aa, Artificial Sequence
  synthetic novel tartgeting peptide IT-171
SVRAVKPIDKTVARHFPGDFIVN

SEQ ID NO: 238 - protein, 13 aa, Artificial Sequence
  synthetic novel tartgeting peptide IT-172
FEGLKNLLGDDII

SEQ ID NO: 239 - protein, 12 aa, Artificial Sequence
  synthetic novel tartgeting peptide IT-173
LFRKEDQEHVLL

SEQ ID NO: 240 - protein, 21 aa, Artificial Sequence
  synthetic novel tartgeting peptide IT-174
SGGSDTDGSSSGEPGSHSGDL

SEQ ID NO: 241 - protein, 10 aa, Artificial Sequence
  synthetic novel tartgeting peptide IT-175
GEPGSHSGDL

SEQ ID NO: 242 - protein, 27 aa, Artificial Sequence
  synthetic novel tartgeting peptide IT-176
PVGDIMSGFLRGANQPRFLLDHISFGS

SEQ ID NO: 243 - protein, 26 aa, Artificial Sequence
  synthetic novel tartgeting peptide IT-177
GTNVPTQILGYSREERFDYEPAPEQR

SEQ ID NO: 244 - protein, 27 aa, Artificial Sequence
  synthetic novel tartgeting peptide IT-178
LLASHPERLSLGVFFVYRVLHLLLENT

SEQ ID NO: 245 - protein, 16 aa, Artificial Sequence
  synthetic novel tartgeting peptide IT-179
TCYPLIQRKTDRAYEA

SEQ ID NO: 246 - protein, 10 aa, Artificial Sequence
  synthetic novel tartgeting peptide IT-180
VVFGGGDRLV

SEQ ID NO: 247 - protein, 7 aa, Artificial Sequence
  synthetic novel tartgeting peptide IT-181
YGKESDP

SEQ ID NO: 248 - protein, 18 aa, Artificial Sequence
  synthetic novel tartgeting peptide IT-182
LTASICRQWNDNSTPYQR

SEQ ID NO: 249 - protein, 27 aa, Artificial Sequence
  synthetic novel tartgeting peptide IT-183
PLRSFVAEKAEHAFRVVRIADFDFGHS

SEQ ID NO: 250 - protein, 18 aa, Artificial Sequence
  synthetic novel tartgeting peptide IT-184
ALLVLNLLLMQFFFGKNM

SEQ ID NO: 251 - protein, 17 aa, Artificial Sequence
  synthetic novel tartgeting peptide IT-185
HYHFLLEFGFHKGDYLE

SEQ ID NO: 252 - protein, 18 aa, Artificial Sequence
  synthetic novel tartgeting peptide IT-186
LAKKNQALREEISRQKSK

SEQ ID NO: 253 - protein, 18 aa, Artificial Sequence
  synthetic novel tartgeting peptide IT-187
RAGRIKKLSQKEAEPFEN

SEQ ID NO: 254 - protein, 8 aa, Artificial Sequence
  synthetic novel tartgeting peptide IT-188
HRKDVYKK

SEQ ID NO: 255 - protein, 32 aa, Artificial Sequence
  synthetic novel tartgeting peptide IT-189
FIRSKLRRVDFSGVRRGNKHFLLDKLLITLVK

SEQ ID NO: 256 - protein, 41 aa, Artificial Sequence
  synthetic novel tartgeting peptide IT-190
IQIIVNAFVEKDKTGAVIEVLYASNNHEKVKAKYEELVAIS

SEQ ID NO: 257 - protein, 24 aa, Artificial Sequence
  synthetic novel tartgeting peptide IT-191
SALFYDTLAAIWISIAGVDARWGH

SEQ ID NO: 258 - protein, 17 aa, Artificial Sequence
  synthetic novel tartgeting peptide IT-192
ILVLLALQVELDSKFQY

SEQ ID NO: 259 - protein, 25 aa, Artificial Sequence
  synthetic novel tartgeting peptide IT-193
LMIFDKHANLKYKYGNRSFGVEAIM

SEQ ID NO: 260 - protein, 20 aa, Artificial Sequence
  synthetic novel tartgeting peptide IT-194
LAGATLVTPYCVGWGLIRSH

SEQ ID NO: 261 - protein, 17 aa, Artificial Sequence
  synthetic novel tartgeting peptide IT-195
AASGFTYCASNGVWHPY

SEQ ID NO: 262 - protein, 32 aa, Artificial Sequence
  synthetic novel tartgeting peptide IT-196
KPEKEKLDTNTLMKVVNKALSLFDRLLIKFGA

SEQ ID NO: 263 - protein, 41 aa, Artificial Sequence
  synthetic novel tartgeting peptide IT-197
TEILNFLITVCADRENWKIKHGLSDSVLLIFFARFTGAEYW

SEQ ID NO: 264 - protein, 51 aa, Artificial Sequence
  synthetic novel tartgeting peptide IT-198
MPVSKKRYMLSSAYATALGICYGQVATDEKESEITAIPDLLDYLSVEEYLL

SEQ ID NO: 265 - protein, 18 aa, Artificial Sequence
  synthetic novel tartgeting peptide IT-199
RAGRIKKLSQKEAEPFEN

SEQ ID NO: 266 - protein, 42 aa, Artificial Sequence
  synthetic novel tartgeting peptide IT-200
MRFKRFDRDYALSGDNVFEVLTASCDVIERNLSYREMCGLMQ

SEQ ID NO: 267 - protein, 18 aa, Artificial Sequence
  synthetic novel tartgeting peptide IT-201
KRKHENVIVAEEMRVIKN

SEQ ID NO: 268 - protein, 41 aa, Artificial Sequence
  synthetic novel tartgeting peptide IT-202
LCRLEKLCKQFLRQDKVVTYYLMLPYKRAIEAFYQELKERS

SEQ ID NO: 269 - protein, 37 aa, Artificial Sequence
  synthetic novel tartgeting peptide IT-203
YPFCLATVDHLPEGLSVTDYERVQRLVSQFLLNKEER

SEQ ID NO: 270 - protein, 24 aa, Artificial Sequence
  synthetic novel tartgeting peptide IT-204
KYLFLASKTKEYFKSHFREIMIDV

SEQ ID NO: 271 - protein, 36 aa, Artificial Sequence
  synthetic novel tartgeting peptide IT-205
FISFVDCIQNIEKIEKELLKIGITDIQINQDAGWLY

SEQ ID NO: 272 - protein, 9 aa, Artificial Sequence
  synthetic novel tartgeting peptide IT-206
AGFAAGYSL

SEQ ID NO: 273 - protein, 30 aa, Artificial Sequence
  synthetic novel tartgeting peptide IT-207
SPLEKYGTGSMTALTFLLGCCLLVLSKKSR

SEQ ID NO: 274 - protein, 25 aa, Artificial Sequence
  synthetic novel tartgeting peptide IT-208
KRKRWAILTLFLAGLGAVGIVLATF

SEQ ID NO: 275 - protein, 12 aa, Artificial Sequence
  synthetic novel tartgeting peptide IT-209
WSGAAVGAATFC

SEQ ID NO: 276 - protein, 34 aa, Artificial Sequence
  synthetic novel tartgeting peptide IT-210
SVGMGVIERGSFDFSASAILQKRETKCLKNKPFT

SEQ ID NO: 277 - protein, 10 aa, Artificial Sequence
  synthetic novel tartgeting peptide IT-211
AEPIIKVTEG

SEQ ID NO: 278 - protein, 16 aa, Artificial Sequence
  synthetic novel tartgeting peptide IT-212
LLSALIKKLALIIFIG

SEQ ID NO: 279 - protein, 21 aa, Artificial Sequence
  synthetic novel tartgeting peptide IT-213
AYLLTCAAAGGMIGYGAATLD

SEQ ID NO: 280 - protein, 10 aa, Artificial Sequence
  synthetic novel tartgeting peptide IT-214
MIGYGAATLD

SEQ ID NO: 281 - protein, 34 aa, Artificial Sequence
  synthetic novel tartgeting peptide IT-215
VCFKDISVFLSPFRGQEVLFCGKAKHSLIYVIGT

SEQ ID NO: 282 - protein, 13 aa, Artificial Sequence
  synthetic novel tartgeting peptide IT-216
FFLNVIAIRIPHF

SEQ ID NO: 283 - protein, 35 aa, Artificial Sequence; identical to SEQ ID NO: 29
  synthetic novel tartgeting peptide IT-217

SEQ ID NO: 284 - protein, 22 aa, Artificial Sequence
  synthetic novel tartgeting peptide IT-218
KLIFAALGLVFLLIGLRDSRSK

SEQ ID NO: 285 - protein, 16 aa, Artificial Sequence
  synthetic novel tartgeting peptide IT-219
RNINVSATFITEKSLV

SEQ ID NO: 286 - protein, 36 aa, Artificial Sequence
  synthetic novel tartgeting peptide IT-220
AILTFFMALLFTYLKEKAQILYWPLFLHLMFYFVTA

SEQ ID NO: 287 - protein, 37 aa, Artificial Sequence
  synthetic novel tartgeting peptide IT-221
DIGRIIGKKGRTITAIRSIVYSVPTQGKKVRLVIDEK

SEQ ID NO: 288 - protein, 24 aa, Artificial Sequence
  synthetic novel tartgeting peptide IT-222
RIEASLISAIMFSMFNAIVKFLQK

SEQ ID NO: 289 - protein, 40 aa, Artificial Sequence
  synthetic novel tartgeting peptide IT-223
NQKMEINSMTSEKEKMLAGHFHNEANFAVIFKYSLFYNFF

SEQ ID NO: 290 - protein, 34 aa, Artificial Sequence
  synthetic novel tartgeting peptide IT-224
VHLFSFVKLIYYDIMKYSIEEKVFFESPVGEIIQ

SEQ ID NO: 291 - protein, 38 aa, Artificial Sequence
  synthetic novel tartgeting peptide IT-225
RRSLGNSASFAEWIEYIRYLHYIIRVQFIHFFSKNKKI

SEQ ID NO: 292 - protein, 38 aa, Artificial Sequence
  synthetic novel tartgeting peptide IT-226
KLQEKQIDRNFERVSGYSTYRAVQAAKAKEKGFISLEN

SEQ ID NO: 293 - protein, 13 aa, Artificial Sequence
  synthetic novel tartgeting peptide IT-227
RFEQFFADHYPFV

SEQ ID NO: 294 - protein, 44 aa, Artificial Sequence
  synthetic novel tartgeting peptide IT-228
IFKLFEEHLLYLLDAFYYSKIFRRLKQGLYRRKEQPYTQDLFRM

SEQ ID NO: 295 - protein, 12 aa, Artificial Sequence
  synthetic novel tartgeting peptide IT-229
LLINYVKVNMSY

SEQ ID NO: 296 - protein, 41 aa, Artificial Sequence
  synthetic novel tartgeting peptide IT-230
EFLEKFKVLKQPRKANNISKNRVAMIFLTIHKSRGFLSSPY

SEQ ID NO: 297 - protein, 11 aa, Artificial Sequence
  synthetic novel tartgeting peptide IT-231
FDFLCSPDSSR

SEQ ID NO: 298 - protein, 38 aa, Artificial Sequence
  synthetic novel tartgeting peptide IT-232
AYSLTFQNPNDNLTDEEVAKYMEKITKALTEKIGAEVR

SEQ ID NO: 299 - protein, 41 aa, Artificial Sequence
  synthetic novel tartgeting peptide IT-233
TDQELEHLIVTELESKRLDFTYSKDITEFFDEAFPEYDQNY

SEQ ID NO: 300 - protein, 41 aa, Artificial Sequence
  synthetic novel tartgeting peptide IT-234
DNFYLILKMEERGKSKKTSQTRGFRAFFDIIRKKIKKEDGK

SEQ ID NO: 301 - protein, 27 aa, Artificial Sequence
  synthetic novel tartgeting peptide IT-235
GWLSDDFWLKSAIPLLKKRLAKWNETL

SEQ ID NO: 302 - protein, 39 aa, Artificial Sequence
  synthetic novel tartgeting peptide IT-236
PVQKALHVVSAYATDLGICYDQVVTVMIREVKTQLYQIY

SEQ ID NO: 303 - protein, 21 aa, Artificial Sequence
  synthetic novel tartgeting peptide IT-237
EDPVPNHFTLRRNKKEKPSKS

SEQ ID NO: 304 - protein, 35 aa, Artificial Sequence
  synthetic novel tartgeting peptide IT-238
IFNRRKFFQYFGLSKEAMVEHIQPFILDIWQIHLF

SEQ ID NO: 305 - protein, 29 aa, Artificial Sequence
  synthetic novel tartgeting peptide IT-239
ADDLLNKRLTDLIMENAETVKTIDLDNSD

SEQ ID NO: 306 - protein, 40 aa, Artificial Sequence
  synthetic novel tartgeting peptide IT-240
VILGNGISNIAQTLGQLPNIAWVWIYMVLIAALLEESNVC

SEQ ID NO: 307 - protein, 28 aa, Artificial Sequence
  synthetic novel tartgeting peptide IT-241
TQKTYLHIIRELENQDIDLIMRSLTSLT

SEQ ID NO: 308 - protein, 30 aa, Artificial Sequence
  synthetic novel tartgeting peptide IT-242
KQVQNTTLIICGTVLLGILFKSYLKSQKSV

SEQ ID NO: 309 - protein, 36 aa, Artificial Sequence
  synthetic novel tartgeting peptide IT-243
SENIARFAAAFENEQVVSYARWFRRSWRGSGSSSRF

SEQ ID NO: 310 - protein, 30 aa, Artificial Sequence
  synthetic novel tartgeting peptide IT-244
MTWAEIGAIVGATIGSFYIPNPVIVPFRVR

SEQ ID NO: 311 - protein, 16 aa, Artificial Sequence
  synthetic novel tartgeting peptide IT-245
IIGGISGAGVGIASFC

SEQ ID NO: 312 - protein, 12 aa, Artificial Sequence
  synthetic novel tartgeting peptide IT-246
ISGAGVGIASFC

SEQ ID NO: 313 - protein, 40 aa, Artificial Sequence
  synthetic novel tartgeting peptide IT-247
LSISQRTDRVIVMDKGKIIEEGTHSELIAANGFYHHLFNK

SEQ ID NO: 314 - protein, 9 aa, Artificial Sequence
  synthetic novel tartgeting peptide IT-248
IGGALNSCG

SEQ ID NO: 315 - protein, 52 aa, Artificial Sequence
  synthetic novel tartgeting peptide IT-249
VFSVLKHTTWPTRKQSWHDFISILEYSAFFALVIFIFDKLLTLGLAELLKRF

SEQ ID NO: 316 - protein, 38 aa, Artificial Sequence
  synthetic novel tartgeting peptide IT-250
LVQGDTILIENHVGTPVKDDGKDCLIIREADVLAVVND

SEQ ID NO: 317 - protein, 31 aa, Artificial Sequence
  synthetic novel tartgeting peptide IT-251
LVMNDETIYLFTYENGQISYEEDKRDCSKNV

SEQ ID NO: 318 - protein, 30 aa, Artificial Sequence
  synthetic novel tartgeting peptide IT-252
MKKNLKRFYALVLGFIIGCLFVSILIFIGY

SEQ ID NO: 319 - protein, 41 aa, Artificial Sequence
  synthetic novel tartgeting peptide IT-253
KTKESLTQQEKKFLKDYDRKSLHHFRDILTYCFILDKLTNK

SEQ ID NO: 320 - protein, 40 aa, Artificial Sequence
  synthetic novel tartgeting peptide IT-254
RFLKDELSVSVRLQEKSIEALPFRTKIEIEIESDNQIKTL

SEQ ID NO: 321 - protein, 40 aa, Artificial Sequence
  synthetic novel tartgeting peptide IT-255
LFIVEYKDKASVPGEIDNTYVESYTYSDILTEKTLIRYFD

SEQ ID NO: 322 - protein, 20 aa, Artificial Sequence
  synthetic novel tartgeting peptide IT-256
KGKSLMPLLKQINQWGKLYL

SEQ ID NO: 323 - protein, 48 aa, Artificial Sequence
  synthetic novel tartgeting peptide IT-257
IILAKAADLAEIERIISEDPFKINEIANYDIIEFCPTKSSKAFEKVLK

SEQ ID NO: 324 - protein, 29 aa, Artificial Sequence
  synthetic novel tartgeting peptide IT-258
TINIDDKVLDYLKKINSKAITIDLIGCAS

SEQ ID NO: 325 - protein, 20 aa, Artificial Sequence
  synthetic novel tartgeting peptide IT-259
EKLKKILLKLAVCGKAWYTL

SEQ ID NO: 326 - protein, 32 aa, Artificial Sequence
  synthetic novel tartgeting peptide IT-260
NILYFIHDENQWEPQKAEIFRGSIKHCAWLSS

SEQ ID NO: 327 - protein, 29 aa, Artificial Sequence
  synthetic novel tartgeting peptide IT-261
SFEKNKIENNLKIAQAYIYIKPKPRICQA

SEQ ID NO: 328 - protein, 12 aa, Artificial Sequence
  synthetic novel tartgeting peptide IT-262
LSLPLIVLTKSI

SEQ ID NO: 329 - protein, 23 aa, Artificial Sequence
  synthetic novel tartgeting peptide IT-263
FIAVSFTGNPATFKLVIGCKADN

SEQ ID NO: 330 - protein, 22 aa, Artificial Sequence
  synthetic novel tartgeting peptide IT-264
LEGKFYMAEDFDKTPECFKDYV

SEQ ID NO: 331 - protein, 30 aa, Artificial Sequence
  synthetic novel tartgeting peptide IT-265
GMFENLLMINFQIMNDLKIEIVVKDRICAV

SEQ ID NO: 332 - protein, 12 aa, Artificial Sequence
  synthetic novel tartgeting peptide IT-266
RAGTWLVVDEIR

SEQ ID NO: 333 - protein, 26 aa, Artificial Sequence
  synthetic novel tartgeting peptide IT-267
RIKEERKNRSYKFFIWRLFDEKTGFI

SEQ ID NO: 334 - protein, 26 aa, Artificial Sequence
  synthetic novel tartgeting peptide IT-268
PITPKKEKCGLGTYAPKNPVFSKSRV

SEQ ID NO: 335 - protein, 16 aa, Artificial Sequence
  synthetic novel tartgeting peptide IT-269
PLYVAAVEKINTAKKH

SEQ ID NO: 336 - protein, 13 aa, Artificial Sequence
  synthetic novel tartgeting peptide IT-270
VHEFDIQKILQNR

SEQ ID NO: 337 - protein, 29 aa, Artificial Sequence
  synthetic novel tartgeting peptide IT-271
FLIQKFLLIKTFPPYRKKYVVIVSQTGTA

SEQ ID NO: 338 - protein, 31 aa, Artificial Sequence
  synthetic novel tartgeting peptide IT-272
QLAPIDKQLKAVKKIAFYESESTAAKAVTVA

SEQ ID NO: 339 - protein, 31 aa, Artificial Sequence
  synthetic novel tartgeting peptide IT-273
YNEPNYKWLESYKIYKQRCEDRTGMYYTEET

SEQ ID NO: 340 - protein, 26 aa, Artificial Sequence
  synthetic novel tartgeting peptide IT-274
ETTTEINAIKLHRIKQRSPQGTRRVN

SEQ ID NO: 341 - protein, 30 aa, Artificial Sequence
  synthetic novel tartgeting peptide IT-275
QVLKNFSISRRYKINNPFFKILLFIQLRTL

SEQ ID NO: 342 - protein, 24 aa, Artificial Sequence
  synthetic novel tartgeting peptide IT-276
ILTLLILGSIGFFILKIKLKLGRF

SEQ ID NO: 343 - protein, 18 aa, Artificial Sequence
  synthetic novel tartgeting peptide IT-277
IYYMRFVNKPLEKTFFKI

SEQ ID NO: 344 - protein, 26 aa, Artificial Sequence
  synthetic novel tartgeting peptide IT-278
SINSSAGIQPHCLSSSFVLRTKHCFY

SEQ ID NO: 345 - protein, 10 aa, Artificial Sequence
  synthetic novel tartgeting peptide IT-279
FVLRTKHCFY

SEQ ID NO: 346 - protein, 29 aa, Artificial Sequence
  synthetic novel tartgeting peptide IT-280
TNNKNKVIIKAIKFKNKDFINLDLFIYRR

SEQ ID NO: 347 - protein, 28 aa, Artificial Sequence
  synthetic novel tartgeting peptide IT-281
KYEKLTKENLFIRNSGNMCVFIYFLFFG

SEQ ID NO: 348 - protein, 9 aa, Artificial Sequence
  synthetic novel tartgeting peptide IT-282
ISLVFPAYT

SEQ ID NO: 349 - protein, 32 aa, Artificial Sequence
  synthetic novel tartgeting peptide IT-283
LCTKLEDKQRGRIPAELFIISPIKILERNDAL

SEQ ID NO: 350 - protein, 10 aa, Artificial Sequence
  synthetic novel tartgeting peptide IT-284
FQYYFSLKRV

SEQ ID NO: 351 - protein, 31 aa, Artificial Sequence
  synthetic novel tartgeting peptide IT-285
FFPYYLADFYKQLKFLNEYQTKNKDKVVEFK

SEQ ID NO: 352 - protein, 29 aa, Artificial Sequence
  synthetic novel tartgeting peptide IT-286
LGFFNNKADLVKADTERDNRMSSLKIKDL

SEQ ID NO: 353 - protein, 14 aa, Artificial Sequence
  synthetic novel tartgeting peptide IT-287
KGYPLPFQYRLNNH

SEQ ID NO: 354 - protein, 20 aa, Artificial Sequence
  synthetic novel tartgeting peptide IT-288
RWVGGEPSADIYLSAKDTKT

SEQ ID NO: 355 - protein, 15 aa, Artificial Sequence
  synthetic novel tartgeting peptide IT-289
EPSADIYLSAKDTKT

SEQ ID NO: 356 - protein, 18 aa, Artificial Sequence
  synthetic novel tartgeting peptide IT-290
IINQLNLILLRLMEILIL

SEQ ID NO: 357 - protein, 31 aa, Artificial Sequence
  synthetic novel tartgeting peptide IT-291
DMKIIKLYIKILSFLFIKYCNKKLNSVKLKA

SEQ ID NO: 358 - protein, 18 aa, Artificial Sequence
  synthetic novel tartgeting peptide IT-292
IINQLNLILLRLMEILIL

SEQ ID NO: 359 - protein, 32 aa, Artificial Sequence
  synthetic novel tartgeting peptide IT-293
HVEDCFLLSNARTTAIHGRANPARGEPRTRSE

SEQ ID NO: 360 - protein, 17 aa, Artificial Sequence
  synthetic novel tartgeting peptide IT-294
YDKIADGVFKIGKRGVL

SEQ ID NO: 361 - protein, 9 aa, Artificial Sequence
  synthetic novel tartgeting peptide IT-295
KYKLKKIIL

SEQ ID NO: 362 - protein, 20 aa, Artificial Sequence
  synthetic novel tartgeting peptide IT-296
EYSQQSFKAKPCSERGVLSP

SEQ ID NO: 363 - protein, 32 aa, Artificial Sequence
  synthetic novel tartgeting peptide IT-297
RSLRLNNALTKLPKLWYNRIKEAFYAYNDYDK

SEQ ID NO: 364 - protein, 29 aa, Artificial Sequence
  synthetic novel tartgeting peptide IT-298
ILNKKPKLPLWKLGKNYFRRFYVLPTFLA

SEQ ID NO: 365 - protein, 23 aa, Artificial Sequence
  synthetic novel tartgeting peptide IT-299
SMLTSFLRSKNTRSLKMYKDVHF

SEQ ID NO: 366 - protein, 29 aa, Artificial Sequence
  synthetic novel tartgeting peptide IT-300
PLIISKAQIKMSGDILGSCFKLFYLRPFF

SEQ ID NO: 367 - protein, 13 aa, Artificial Sequence
  synthetic novel tartgeting peptide IT-301
SKLPRVLDASLKL

SEQ ID NO: 368 - protein, 15 aa, Artificial Sequence
  synthetic novel tartgeting peptide IT-302
IIIILPKIYLVCKTV

SEQ ID NO: 369 - protein, 14 aa, Artificial Sequence
  synthetic novel tartgeting peptide IT-303
LDYENMDCKKRIRI

SEQ ID NO: 370 - protein, 24 aa, Artificial Sequence
  synthetic novel tartgeting peptide IT-304
STAGEASRRTASEASRRTAAKLRG

SEQ ID NO: 371 - protein, 26 aa, Artificial Sequence
  synthetic novel tartgeting peptide IT-305
ARNALNMRDVPVDAAIIGIIDGMDEE

SEQ ID NO: 372 - protein, 25 aa, Artificial Sequence
  synthetic novel tartgeting peptide IT-306
KILNEAEGKLLKVIEKNGEIDIEEI

SEQ ID NO: 373 - protein, 24 aa, Artificial Sequence
  synthetic novel tartgeting peptide IT-307
NGDKKAKEELDKWDEVIKELNIQF

SEQ ID NO: 374 - protein, 34 aa, Artificial Sequence
  synthetic novel tartgeting peptide IT-308
GLVIIPNLIALIILFSQVRQQTKDYFSNPKLSSR

SEQ ID NO: 375 - protein, 34 aa, Artificial Sequence
  synthetic novel tartgeting peptide IT-309
EPLPLTKYDKKDTEMKKVFKEILAGKVGYEKEEE

SEQ ID NO: 376 - protein, 23 aa, Artificial Sequence
  synthetic novel tartgeting peptide IT-310
TKLKKNNKLLSAKKENTLHTKDK

SEQ ID NO: 377 - protein, 9 aa, Artificial Sequence
  synthetic novel tartgeting peptide IT-311
AIFDAMHNL

SEQ ID NO: 378 - protein, 16 aa, Artificial Sequence
  synthetic illustrative additional tartgeting peptide LPSB-1
RGLRRLGRRGLRRLGR

SEQ ID NO: 379 - protein, 13 aa, Artificial Sequence
  synthetic illustrative additional tartgeting peptide Phob-1
KPVLPVLPVLPVL

SEQ ID NO: 380 - protein, 16 aa, Artificial Sequence
  synthetic illustrative additional tartgeting peptide LPSB-2
VLRIIRIAVLRIIRIA

SEQ ID NO: 381 - protein, 15 aa, Artificial Sequence
  synthetic illustrative additional tartgeting peptide LPTG-1
LPETGGSGGSLPETG

SEQ ID NO: 382 - protein, 11 aa, Artificial Sequence
  synthetic illustrative additional tartgeting peptide alpha-1
RAHIRRAHIRR

SEQ ID NO: 383 - protein, 14 aa, Artificial Sequence
  synthetic illustrative additional tartgeting peptide ANION-1
DEDEDDEEDDDEEE

SEQ ID NO: 384 - protein, 15 aa, Artificial Sequence
  synthetic illustrative additional tartgeting peptide PHILIC-1
STMCGSTMCGSTMCG

SEQ ID NO: 385 - protein, 12 aa, Artificial Sequence
  synthetic illustrative additional tartgeting peptide SA5.1
VRLPLWLPSLNE

SEQ ID NO: 386 - protein, 12 aa, Artificial Sequence
  synthetic illustrative additional tartgeting peptide SA5.3
ANYFLPPVLSSS

SEQ ID NO: 387 - protein, 12 aa, Artificial Sequence
  synthetic illustrative additional tartgeting peptide SA5.4
SHPWNAQRELSV

SEQ ID NO: 388 - protein, 12 aa, Artificial Sequence
  synthetic illustrative additional tartgeting peptide SA5.5
SVSVGMRPMPRP

SEQ ID NO: 389 - protein, 12 aa, Artificial Sequence
  synthetic illustrative additional tartgeting peptide SA5.6
WTPLHPSTNRPP

SEQ ID NO: 390 - protein, 12 aa, Artificial Sequence
  synthetic illustrative additional tartgeting peptide SA5.7
SVSVGMKPSPRP

SEQ ID NO: 391 - protein, 12 aa, Artificial Sequence
  synthetic illustrative additional tartgeting peptide SA5.8
SVSVGMKPSPRP

SEQ ID NO: 392 - protein, 12 aa, Artificial Sequence
  synthetic illustrative additional tartgeting peptide SA5.9
SVPVGPYNESQP

SEQ ID NO: 393 - protein, 12 aa, Artificial Sequence
  synthetic illustrative additional tartgeting peptide SA5.10
WAPPLFRSSLFY

SEQ ID NO: 394 - protein, 12 aa, Artificial Sequence
  synthetic illustrative additional tartgeting peptide SA2.2
  VARIANT (5)...(7): Xaa = any amino acid
WAPPXPXSSLFY

SEQ ID NO: 395 - protein, 12 aa, Artificial Sequence
  synthetic illustrative additional tartgeting peptide SA2.4
HHGWTHHWPPPP

SEQ ID NO: 396 - protein, 12 aa, Artificial Sequence
  synthetic illustrative additional tartgeting peptide SA2.5
SYYSLPPIFHIP

SEQ ID NO: 397 - protein, 13 aa, Artificial Sequence
  synthetic illustrative additional tartgeting peptide SA2.6
HFQENPLSRGGEL

SEQ ID NO: 398 - protein, 12 aa, Artificial Sequence
  synthetic illustrative additional tartgeting peptide SA2.7
FSYSPTRAPLNM

SEQ ID NO: 399 - protein, 12 aa, Artificial Sequence
  synthetic illustrative additional tartgeting peptide SA2.8
  VARIANT (2)...(12): Xaa = any amino acid
SXPXXMKXSXXX

SEQ ID NO: 400 - protein, 12 aa, Artificial Sequence
  synthetic illustrative additional tartgeting peptide SA2.9
VSRHQSWHPHDL

SEQ ID NO: 401 - protein, 12 aa, Artificial Sequence
  synthetic illustrative additional tartgeting peptide SA2.10
  VARIANT (3)...(10): Xaa = any amino acid
DYXYRGLPRXET

SEQ ID NO: 402 - protein, 12 aa, Artificial Sequence
  synthetic illustrative additional tartgeting peptide SA2.11
SVSVGMKPSPRP

SEQ ID NO: 403 - protein, 12 aa, Artificial Sequence
  synthetic illustrative additional tartgeting peptide S. aureus/Consensus
  VARIANT (1)...(1): Xaa = Val, Gln or His
  VARIANT (2)...(2): Xaa = Pro or His
  VARIANT (5)...(5): Xaa = Phe or Tyr
  VARIANT (6)...(6): Xaa = Lys or His
  VARIANT (7)...(7): Xaa = His or Ala
  VARIANT (8)...(8): Xaa = Leu or His
  VARIANT (9)...(10): Xaa = any amino acid
  VARIANT (11)...(11): Xaa = Lys or Arg
  VARIANT (12)...(12): Xaa = Pro or Leu
XXHEXXXXXXXX

SEQ ID NO: 404 - protein, 12 aa, Artificial Sequence
  synthetic illustrative additional tartgeting peptide DH5.1
KHLQNRSTGYET

SEQ ID NO: 405 - protein, 12 aa, Artificial Sequence
  synthetic illustrative additional tartgeting peptide DH5.2
HIHSLSPSKTWP

SEQ ID NO: 406 - protein, 12 aa, Artificial Sequence
  synthetic illustrative additional tartgeting peptide DH5.3
TITPTDAEMPFL

SEQ ID NO: 407 - protein, 12 aa, Artificial Sequence
  synthetic illustrative additional tartgeting peptide DH5.4
HLLESGVLERGM

SEQ ID NO: 408 - protein, 12 aa, Artificial Sequence
  synthetic illustrative additional tartgeting peptide DH5.5
HDRYHIPPLQLH

SEQ ID NO: 409 - protein, 12 aa, Artificial Sequence
  synthetic illustrative additional tartgeting peptide DH5.6
VNTLQNVRHMAA

SEQ ID NO: 410 - protein, 12 aa, Artificial Sequence
  synthetic illustrative additional tartgeting peptide DH5.7
SNYMKLRAVSPF

SEQ ID NO: 411 - protein, 12 aa, Artificial Sequence
  synthetic illustrative additional tartgeting peptide DH5.8
NLQMPYAWRTEF

SEQ ID NO: 412 - protein, 12 aa, Artificial Sequence
  synthetic illustrative additional tartgeting peptide DH5.9
QKPLTGPHFSLI

SEQ ID NO: 413 - protein, 21 aa, Artificial Sequence
  synthetic illustrative additional tartgeting peptide CSP
SGSLSTFFRLFNRSFTQALGK

SEQ ID NO: 414 - protein, 18 aa, Artificial Sequence
  synthetic illustrative additional tartgeting peptide CSPC18
LSTFFRLFNRSFTQALGK

SEQ ID NO: 415 - protein, 16 aa, Artificial Sequence
  synthetic illustrative additional tartgeting peptide CSPC16
TFFRLFNRSFTQALGK

SEQ ID NO: 416 - protein, 8 aa, Artificial Sequence
  synthetic illustrative additional tartgeting peptide CSPM8
TFFRLFNR

SEQ ID NO: 417 - protein, 12 aa, Artificial Sequence
  synthetic illustrative additional tartgeting peptide KH
KKHRKHRKHRKH

SEQ ID NO: 418 - protein, 7 aa, Artificial Sequence
  synthetic illustrative additional tartgeting peptide cCF10
LVTLVFV

SEQ ID NO: 419 - protein, 8 aa, Artificial Sequence
  synthetic illustrative additional tartgeting peptide AgrD1
YSTCDFIM

SEQ ID NO: 420 - protein, 9 aa, Artificial Sequence
  synthetic illustrative additional tartgeting peptide AgrD2
GVNACSSLF

SEQ ID NO: 421 - protein, 8 aa, Artificial Sequence
  synthetic illustrative additional tartgeting peptide AgrD3
YINCDFLL

SEQ ID NO: 422 - protein, 36 aa, Artificial Sequence
  synthetic illustrative additional tartgeting peptide Nisin A
ITSISLCTPGCKTGALMGCNMRTATCIICSIIIVSK

SEQ ID NO: 423 - protein, 26 aa, Artificial Sequence
  synthetic illustrative additional tartgeting peptide PlnA
KSSAYSLQMGATAIKQVKKLFKKWGW

SEQ ID NO: 424 - protein, 9 aa, Artificial Sequence
  synthetic illustrative additional tartgeting peptide S3L1-5
WWYNWWQDW

SEQ ID NO: 425 - protein, 16 aa, Artificial Sequence
  synthetic illustrative additional tartgeting peptide Penetratin
  MOD_RES (16)...(16): optionally lysinamide
RQIKIWFWNRRMKWKK

SEQ ID NO: 426 - protein, 11 aa, Artificial Sequence
  synthetic illustrative additional tartgeting peptide Tat
EHWSYCDLRPG

SEQ ID NO: 427 - protein, 12 aa, Artificial Sequence
  synthetic illustrative additional tartgeting peptide Pep-1N
KETWWETWWTEW

SEQ ID NO: 428 - protein, 27 aa, Artificial Sequence
  synthetic illustrative additional tartgeting peptide Pep27
MRKEFHNVLSSGQLLADKRPARDYNRK

SEQ ID NO: 429 - protein, 27 aa, Artificial Sequence
  synthetic illustrative additional tartgeting peptide HABP35
LKQKIKHVVKLKVVVKLRSQLVKRKQN

SEQ ID NO: 430 - protein, 15 aa, Artificial Sequence
  synthetic illustrative additional tartgeting peptide HABP42(all D)
STMMSRSHKTRSHHV

SEQ ID NO: 431 - protein, 16 aa, Artificial Sequence
  synthetic illustrative additional tartgeting peptide Hi3/17
GAHWQFNALTVRGGGS

SEQ ID NO: 432 - protein, 15 aa, Artificial Sequence
  synthetic illustrative additional tartgeting peptide Hi3/17
KQRTSIRATEGCLPS

SEQ ID NO: 433 - protein, 10 aa, Artificial Sequence
  synthetic illustrative additional tartgeting peptide alpha-E. coli peptide
QEKIRVRLSA

SEQ ID NO: 434 - protein, 20 aa, Artificial Sequence
  synthetic illustrative additional tartgeting peptide Salivary Receptor Adhesion Fragment
  MOD_RES (20)...(20): optionally valinamide
QLKTADLPAGRDETTSFVLV

SEQ ID NO: 435 - protein, 34 aa, Artificial Sequence
  synthetic illustrative additional tartgeting peptide S1 (Sushi frag.)
GFKLKGMARISCLPNGQWSNFPPKCIRECAMVSS

SEQ ID NO: 436 - protein, 34 aa, Artificial Sequence
  synthetic illustrative additional tartgeting peptide S3 (Sushi frag.)
HAEHKVKIGVEQKYGQFPQGTEVTYTCSGNYFLM

SEQ ID NO: 437 - protein, 20 aa, Artificial Sequence
  synthetic illustrative additional tartgeting peptide MArg.1
AMDMYSIEDRYFGGYAPEVG

SEQ ID NO: 438 - protein, 28 aa, Artificial Sequence
  synthetic illustrative additional tartgeting peptide BPI fragment 1
ASQQGTAALQKELKRIKPDYSDSFKIKH

SEQ ID NO: 439 - protein, 35 aa, Artificial Sequence
  synthetic illustrative additional tartgeting peptide BPI fragment 2
SSQISMVPNVGLKFSISNANIKISGKWKAQKRFLK

SEQ ID NO: 440 - protein, 28 aa, Artificial Sequence
  synthetic illustrative additional tartgeting peptide BPI fragment 3
VHVHISKSKVGWLIQLFHKKIESALRNK

SEQ ID NO: 441 - protein, 29 aa, Artificial Sequence
  synthetic illustrative additional tartgeting peptide LBP fragment 1
AAQEGLLALQSELLRITLPDFTGDLRIPH

SEQ ID NO: 442 - protein, 35 aa, Artificial Sequence
  synthetic illustrative additional tartgeting peptide LBP fragment 2
HSALRPVPGQGLSLSISDSSIRVQGRWKVRKSFFK

SEQ ID NO: 443 - protein, 27 aa, Artificial Sequence
  synthetic illustrative additional tartgeting peptide LBP fragment 3
VEVDMSGDLGWLLNLFHNQIESKFQKV

SEQ ID NO: 444 - protein, 8 aa, Artificial Sequence
  synthetic illustrative additional tartgeting peptide B. anthracis spore binding
ATYPLPIR

SEQ ID NO: 445 - protein, 4 aa, Artificial Sequence
  synthetic illustrative additional tartgeting peptide Bacillus spore binding
NHFL

SEQ ID NO: 446 - protein, 5 aa, Artificial Sequence
  synthetic illustrative additional tartgeting peptide Bacillus spore binding
NHFLP

SEQ ID NO: 447 - protein, 7 aa, Artificial Sequence
  synthetic illustrative additional tartgeting peptide Bacillus spore binding
TSQNVRT

SEQ ID NO: 448 - protein, 7 aa, Artificial Sequence
  synthetic illustrative additional tartgeting peptide Bacillus spore binding
  VARIANT (4)...(6): Xaa = Ile, Val or Leu
TYPXPXR

SEQ ID NO: 449 - protein, 7 aa, Artificial Sequence
  synthetic illustrative additional tartgeting peptide Bacillus spore binding
TSQNVRT

SEQ ID NO: 450 - protein, 7 aa, Artificial Sequence
  synthetic illustrative additional tartgeting peptide Bacillus spore binding
TYPLPIR

SEQ ID NO: 451 - protein, 8 aa, Artificial Sequence
  synthetic illustrative additional tartgeting peptide LPS binding peptide 1
TFRRLKWK

SEQ ID NO: 452 - protein, 12 aa, Artificial Sequence
  synthetic illustrative additional tartgeting peptide LPS BP 2
RWKVRKSFFKLQ

SEQ ID NO: 453 - protein, 12 aa, Artificial Sequence
  synthetic illustrative additional tartgeting peptide LPS BP 3
KWKAQKRFLKMS

SEQ ID NO: 454 - protein, 17 aa, Artificial Sequence
  synthetic illustrative additional tartgeting peptide Pseudomonas pilin binding peptide
KCTSDQDEQFIPKGCSK

SEQ ID NO: 455 - protein, 21 aa, Enterococcus faecalis
MKQQKKHIAALLFALILTLVS

SEQ ID NO: 456 - protein, 7 aa, Enterococcus faecalis
SIFTLVA

SEQ ID NO: 457 - protein, 8 aa, Enterococcus faecalis
LFSLVLAG

SEQ ID NO: 458 - protein, 7 aa, Enterococcus faecalis
AIFILAS

SEQ ID NO: 459 - protein, 8 aa, Enterococcus faecalis
FLVMFLSG

SEQ ID NO: 460 - protein, 22 aa, Lactobacillus paracasei
DSIRDVSPTFNKIRRWFDGLFK

SEQ ID NO: 461 - protein, 22 aa, Enterococcus faecalis
MSKRAMKKIIPLITLFVVTLVG

SEQ ID NO: 462 - protein, 9 aa, Bacillus amyloliquefaciens
KDEIYWKPS

SEQ ID NO: 463 - protein, 8 aa, Staphylococcus aureus
YSTCDFIM

SEQ ID NO: 464 - protein, 18 aa, Streptococcus pneumoniae
GLWEDLLYNINRYAHYIT

SEQ ID NO: 465 - protein, 19 aa, Streptococcus gordonii
DIRHRINNSIWRDIFLKRK

SEQ ID NO: 466 - protein, 19 aa, Streptococcus gordonii
DVRSNKIRLWWENIFFNKK

SEQ ID NO: 467 - protein, 8 aa, Bacillus mojavensis
PTTREWDG

SEQ ID NO: 468 - protein, 12 aa, Bacillus mojavensis
LQIYTNGNWVPS

SEQ ID NO: 469 - protein, 22 aa, Enterococcus faecalis
MSKRAMKKIIPLITLFVVTLVG

SEQ ID NO: 470 - protein, 21 aa, Enterococcus faecium
GAGKNLIYGMGYGYLRSCNRL

SEQ ID NO: 471 - protein, 17 aa, Streptococcus pneumoniae
EMRLSKFFRDFILQRKK

SEQ ID NO: 472 - protein, 12 aa, Enterococcus faecalis
WSEIEINTKQSN

SEQ ID NO: 473 - protein, 10 aa, Enterococcus faecalis
HISKERFEAY

SEQ ID NO: 474 - protein, 21 aa, Enterococcus faecalis
KYKCSWCKRVYTLRKDHRTAR

SEQ ID NO: 475 - protein, 12 aa, Enterococcus faecalis
WSEIEINTKQSN

SEQ ID NO: 476 - protein, 23 aa, Enterococcus faecalis
MKTTLKKLSRYIAVVIAITLIFI

SEQ ID NO: 477 - protein, 10 aa, Enterococcus faecalis
HISKERFEAY

SEQ ID NO: 478 - protein, 17 aa, Streptococcus oralis
DKRLPYFFKHLFSNRTK

SEQ ID NO: 479 - protein, 16 aa, Streptococcus mitis
EMRKPDGALFNLFRRR

SEQ ID NO: 480 - protein, 16 aa, Streptococcus mitis
EMRKSNNNFFHFLRRI

SEQ ID NO: 481 - protein, 17 aa, Streptococcus mitis
ESRLPKIRFDFIFPRKK

SEQ ID NO: 482 - protein, 16 aa, Streptococcus mitis
EIRQTHNIFFNFFKRR

SEQ ID NO: 483 - protein, 17 aa, Streptococcus oralis
DWRISETIRNLIFPRRK

SEQ ID NO: 484 - protein, 8 aa, Enterococcus faecalis
VAVLVLGA

SEQ ID NO: 485 - protein, 11 aa, Bacillus subtilis
FFEDDKRKSFI

SEQ ID NO: 486 - protein, 11 aa, Bacillus subtilis
FFEDDKRKSFI

SEQ ID NO: 487 - protein, 40 aa, Lactobacillus plantarum
MKQKMYEAIAHLFKYVGAKQLVMCCVGIWFETKIPDELRK

SEQ ID NO: 488 - protein, 40 aa, Lactobacillus plantarum; identical to SEQ ID NO: 487

SEQ ID NO: 489 - protein, 14 aa, Enterococcus faecalis
VVAYVITQVGAIRF

SEQ ID NO: 490 - protein, 14 aa, Enterococcus faecalis
VVAYVITQVGAIRF

SEQ ID NO: 491 - protein, 25 aa, Enterococcus faecalis
LLKLQDDYLLHLERHRRTKKIIDEN

SEQ ID NO: 492 - protein, 31 aa, Enterococcus faecalis
EDIKDLTDKVQSLNALVQSELNKLIKRKDQS

SEQ ID NO: 493 - protein, 19 aa, Enterococcus faecalis
WFLDFSDWLSKVPSKLWAE

SEQ ID NO: 494 - protein, 31 aa, Enterococcus faecalis; identical to SEQ ID NO: 492

SEQ ID NO: 495 - protein, 19 aa, Enterococcus faecalis
WFLDFSDWLSKVPSKLWAE

SEQ ID NO: 496 - skipped

SEQ ID NO: 497 - protein, 40 aa, Ustilago maydis
MLSIFAQTTQTSASEPQQSPTAPQGRDNGSPIGYSSCVVA

SEQ ID NO: 498 - protein, 38 aa, Ustilago maydis
MLSIFETVAAAAPVTVAETQQASNNENRGQPGYYCLIA

SEQ ID NO: 499 - protein, 34 aa, Cryptococcus neoformans
PSLPSSPPSLLPPLPLLKLLATRRPTLVGMTLCV

SEQ ID NO: 500 - protein, 42 aa, Schizosaccharomyces pombe
MDSMANSVSSSSVVNAGNKPAETLNKTVKNYTPKVPYMCVIA

SEQ ID NO: 501 - protein, 39 aa, Schizophyllum commune
MDTFTYVDLAAVAAAAVADEVPRDFEDQITDYQSYCIIC

SEQ ID NO: 502 - protein, 10 aa, Schizophyllum commune
SNVHGWCVVA

SEQ ID NO: 503 - protein, 11 aa, Schizophyllum commune
NTTAHGWCVVA

SEQ ID NO: 504 - protein, 36 aa, Saccharomyces paradoxus
MQPSTVTAAPKDKTSAEKKDNYIIKGVFWDPACVIA

SEQ ID NO: 505 - protein, 9 aa, Coprinopsis cinerea
GPTWWCVNA

SEQ ID NO: 506 - protein, 10 aa, Coprinopsis cinerea
SGPTWFCIIQ

SEQ ID NO: 507 - protein, 31 aa, Cryptococcus neoformans
FTAIFSTLSSSVASKTDAPRNEEAYSSGNSP

SEQ ID NO: 508 - protein, 42 aa, Ustilago hordei
MFSIFAQPAQTSVSETQESPANHGANPGKSGSGLGYSTCVVA

SEQ ID NO: 509 - protein, 11 aa, Schizophyllum commune
NTTAHGWCVVA

SEQ ID NO: 510 - protein, 9 aa, Saccharomyces cerevisiae
SDDNYGSLA

SEQ ID NO: 511 - protein, 10 aa, Coprinopsis cinerea
NGLTFWCVIA

SEQ ID NO: 512 - protein, 8 aa, Coprinopsis cinerea
PSWFCVIA

SEQ ID NO: 513 - protein, 8 aa, Coprinopsis cinerea
ASWFCTIA

SEQ ID NO: 514 - protein, 25 aa, Thanatephorus cucumeris
PHHKIANASDKRRRMYFEIFMCAVL

SEQ ID NO: 515 - protein, 40 aa, Ustilago maydis; identical to SEQ ID NO: 497

SEQ ID NO: 516 - protein, 38 aa, Ustilago maydis; identical to SEQ ID NO: 498

SEQ ID NO: 517 - protein, 10 aa, Schizophyllum commune
SLTYAWCVVA

SEQ ID NO: 518 - protein, 11 aa, Schizophyllum commune
TSMAHAWCVVA

SEQ ID NO: 519 - protein, 6 aa, Schizophyllum commune
GYCVVA

SEQ ID NO: 520 - protein, 40 aa, Ustilago maydis; identical to SEQ ID NO: 497

SEQ ID NO: 521 - protein, 41 aa, Schizosaccharomyces pombe
MDSMANTVSSSVVNTGNKPSETLNKTVKNYTPKVPYMCVIA

SEQ ID NO: 522 - protein, 39 aa, Ustilago hordei
MFSLFETVAAAVKVVSAAEPEHAPTNEGKGEPAPYCIIA

SEQ ID NO: 523 - protein, 8 aa, Coprinus cinereus
LTWFCVIA

SEQ ID NO: 524 - protein, 18 aa, Coprinellus disseminatus
LREKRRRRWFEAFMGFGL

SEQ ID NO: 525 - protein, 40 aa, Ustilago maydis; identical to SEQ ID NO: 497

SEQ ID NO: 526 - protein, 40 aa, Sporisorium reilianum
MDALTLFAPVSLGAVATEQAPVDEERPNRQTFPWIGCVVA

SEQ ID NO: 527 - protein, 38 aa, Sporisorium reilianum
MFIFESVVASVQAVSVAEQDQTPVSEGRGKPAVYCTIA

SEQ ID NO: 528 - protein, 33 aa, Ustilago maydis
PWMSLLFSFLALLALILPKLSKDDPLGLTRQPR

SEQ ID NO: 529 - protein, 31 aa, Saccharomyces cerevisiae
ASISLIMEGSANIEAVGKLVWLAAALPLAFI

SEQ ID NO: 530 - protein, 34 aa, Saccharomyces cerevisiae
ARNVYPSVETPLLQGAAPHDNKQSLVESPPPYVP

SEQ ID NO: 531 - protein, 14 aa, Saccharomyces cerevisiae
FLKKLNRKIASIFN

SEQ ID NO: 532 - protein, 20 aa, Saccharomyces cerevisiae
DSISRQGSISSGPPPRSPNK

SEQ ID NO: 533 - protein, 17 aa, Artificial Sequence
  synthetic novel antimicrobial peptide K-1
GLGRVIGRLIKQIIWRR

SEQ ID NO: 534 - protein, 19 aa, Artificial Sequence
  synthetic novel antimicrobial peptide K-2
VYRKRKSILKIYAKLKGWH

SEQ ID NO: 535 - protein, 25 aa, Artificial Sequence
  synthetic novel antimicrobial peptide K-3
AFYQRKENVISLDPREWLGFNVTEK

SEQ ID NO: 536 - protein, 30 aa, Artificial Sequence
  synthetic novel antimicrobial peptide K-4
DKKRVIERIKSFSLRDEVIHFGELCIYWGK

SEQ ID NO: 537 - protein, 26 aa, Artificial Sequence
  synthetic novel antimicrobial peptide K-5
RSSYNGFSKICFLKIEHFGSYSYQGR

SEQ ID NO: 538 - protein, 12 aa, Artificial Sequence
  synthetic novel antimicrobial peptide K-6
WLNAISLYGRIG

SEQ ID NO: 539 - protein, 20 aa, Artificial Sequence
  synthetic novel antimicrobial peptide K-7
NYRLVNAIFSKIFKKKFIKF

SEQ ID NO: 540 - protein, 11 aa, Artificial Sequence
  synthetic novel antimicrobial peptide K-8
KILKFLFKKVF

SEQ ID NO: 541 - protein, 11 aa, Artificial Sequence
  synthetic novel antimicrobial peptide K-9
FIRKFLKKWLL

SEQ ID NO: 542 - protein, 11 aa, Artificial Sequence
  synthetic novel antimicrobial peptide K-10
KLFKFLRKHLL

SEQ ID NO: 543 - protein, 11 aa, Artificial Sequence
  synthetic novel antimicrobial peptide K-11
KILKFLFKQVF

SEQ ID NO: 544 - protein, 11 aa, Artificial Sequence
  synthetic novel antimicrobial peptide K-12
KILKKLFKFVF

SEQ ID NO: 545 - protein, 11 aa, Artificial Sequence
  synthetic novel antimicrobial peptide K-13
GILKKLFTKVF

SEQ ID NO: 546 - protein, 9 aa, Artificial Sequence
  synthetic novel antimicrobial peptide K-14
LRKFLHKLF

SEQ ID NO: 547 - protein, 9 aa, Artificial Sequence
  synthetic novel antimicrobial peptide K-15
LRKNLRWLF

SEQ ID NO: 548 - protein, 11 aa, Artificial Sequence
  synthetic novel antimicrobial peptide K-16
FIRKFLQKLHL

SEQ ID NO: 549 - protein, 11 aa, Artificial Sequence
  synthetic novel antimicrobial peptide K-17
FTRKFLKFLHL

SEQ ID NO: 550 - protein, 12 aa, Artificial Sequence
  synthetic novel antimicrobial peptide K-18
KKFKKFKVLKIL

SEQ ID NO: 551 - protein, 12 aa, Artificial Sequence
  synthetic novel antimicrobial peptide K-19
LLKLLKLKKLKF

SEQ ID NO: 552 - protein, 25 aa, Streptococcus mutans
DSSQSDSDSDSNSSNTNSNSSITNG

SEQ ID NO: 553 - protein, 25 aa, Streptococcus mutans
LPGTLHIQAEFPVQLEAGSLIQIFD

SEQ ID NO: 554 - protein, 29 aa, Streptococcus mutans
LACTTPVGAVLYLGAEVCAGAAVIYYGAN

SEQ ID NO: 555 - protein, 24 aa, Streptococcus mutans
EIPIQLANDLANYYDISLDSIFFW

SEQ ID NO: 556 - protein, 20 aa, Myxococcus xanthus
RDMTVAGKRPNFLIITTDEE

SEQ ID NO: 557 - protein, 31 aa, Myxococcus xanthus
NTSIVCAVTFAPIKEVPLLWRAGLTLRSRQS

SEQ ID NO: 558 - protein, 29 aa, Myxococcus xanthus
QAKVEREVERDLVYTLRRLCDPSGSERTK

SEQ ID NO: 559 - protein, 29 aa, Streptococcus mutans
PRMIDIISFHGCHGDHQVWTDPQATALPR

SEQ ID NO: 560 - protein, 30 aa, Chassalia parviflora
GIPCGESCVWIPCISAALGCSCKNKVCYRN

SEQ ID NO: 561 - protein, 38 aa, Bos taurus
DFASCHTNGGICLPNRCPGHMIQIGICFRPRVKCCRSW

SEQ ID NO: 562 - protein, 38 aa, Bos taurus
GPLSCGRNGGVCIPIRCPVPMRQIGTCFGRPVKCCRSW

SEQ ID NO: 563 - protein, 76 aa, Macadamia integrifolia
SAFTVWSGPGCNNRAERYSKCGCSAIHQKGGYDFSYTGQTAALYNQAGCSGVAHTRFGSSARACNPFGWKSIFIQC

SEQ ID NO: 564 - protein, 44 aa, Tachypleus tridentatus
YSRCQLQGFNCVVRSYGLPTIPCCRGLTCRSYFPGSTYGRCQRY

SEQ ID NO: 565 - protein, 48 aa, Carnobacterium piscicola
VNYGNGVSCSKTKCSVNWGQAFQERYTAGINSFVSGVASGAGSIGRRP

SEQ ID NO: 566 - protein, 25 aa, Androctonus australis
RSVCRQIKICRRRGGCYYKCTNRPY

SEQ ID NO: 567 - protein, 13 aa, Artificial Sequence
  synthetic tritrpticin, fragment of a porcine neutrophil cathelicidin
VRRFPWWWPFLRR

SEQ ID NO: 568 - protein, 14 aa, Vespula lewisii
INLKALAALAKKIL

SEQ ID NO: 569 - protein, 20 aa, Artificial Sequence
  synthetic cecropinA-magainin2 hybrid
KWKLFKKIGIGKFLHSAKKF

SEQ ID NO: 570 - protein, 30 aa, Homo sapiens
DCYCRIPACIAGERRYGTCIYQGRLWAFCC

SEQ ID NO: 571 - protein, 62 aa, Tachypleus tridentatus
YLAFRCGRYSPCLDDGPNVNLYSCCSFYNCHKCLARLENCPKGLHYNAYLKVCDWPSKAGCT

SEQ ID NO: 572 - protein, 23 aa, Artificial Sequence
  synthetic magainin 2 analog
GIGKYLHSAKKFGKAWVGEIMNS

SEQ ID NO: 573 - protein, 36 aa, Homo sapiens
DHYNCVSSGGQCLYSACPIFTKIQGTCYRGKAKCCK

SEQ ID NO: 574 - protein, 32 aa, Orychtolagus cuniculus
MPCSCKKYCDPWEVIDGSCGLFNSKYICCREK

SEQ ID NO: 575 - protein, 18 aa, Artificial Sequence
  synthetic cecropinA-magainin2 hybrid, P18
KWKLFKKIPKFLHSAKKF

SEQ ID NO: 576 - protein, 20 aa, Artificial Sequence
  synthetic cecropinA-magainin2 hybrid
KLKLFKKIGIGKFLHSAKKF

SEQ ID NO: 577 - protein, 20 aa, Artificial Sequence
  synthetic cecropinA-magainin2 hybrid
KAKLFKKIGIGKFLHSAKKF

SEQ ID NO: 578 - protein, 41 aa, Homo sapiens
GIGDPVTCLKSGAICHPVFCPRRYKQIGTCGLPGTKCCKKP

SEQ ID NO: 579 - protein, 39 aa, Mytilus galloprovincialis
GFGCPNNYQCHRHCKSIPGRCGGYCGGWHRLPCTCYRCG

SEQ ID NO: 580 - protein, 29 aa, Ovis aries
RGLRRLGRKIAHGVKKYGPTVLRIIRIAG

SEQ ID NO: 581 - protein, 13 aa, Bos taurus
ILPWKWPWWPWRR

SEQ ID NO: 582 - protein, 21 aa, Escherichia coli
VGIGTPISFYGGGAGHVPEYF

SEQ ID NO: 583 - protein, 13 aa, Artificial Sequence
  synthetic indolicidin P to A mutant, CP10A
ILAWKWAWWAWRR

SEQ ID NO: 584 - protein, 18 aa, Artificial Sequence
  synthetic ovispirin-1
KNLRRIIRKIIHIIKKYG

SEQ ID NO: 585 - protein, 18 aa, Artificial Sequence
  synthetic novispirin G10
KNLRRIIRKGIHIIKKYG

SEQ ID NO: 586 - protein, 18 aa, Artificial Sequence
  synthetic novispirin T7
KNLRRITRKIIHIIKKYG

SEQ ID NO: 587 - protein, 18 aa, Macaca mulatta
GFCRCLCRRGVCRCICTR

SEQ ID NO: 588 - protein, 44 aa, Artificial Sequence
  synthetic heliomicin variant, Hel-LL
DKLIGSCVWGAVNYTSDCNGECLLRGYKGGHCGSFANVNCWCET

SEQ ID NO: 589 - protein, 40 aa, Phormia terranovae
ATCDLLSGTGINHSACAAHCLLRGNRGGYCNGKGVCVCRN

SEQ ID NO: 590 - protein, 15 aa, Bacillus brevis
VGALAVVVWLFLWLW

SEQ ID NO: 591 - protein, 15 aa, Bacillus brevis
VGALAVVVWLYLWLW

SEQ ID NO: 592 - protein, 18 aa, Acanthoscurria gomesiana
ECRRLCYKQRCVTYCRGR

SEQ ID NO: 593 - protein, 45 aa, Homo sapiens
GIINTLQKYYCRVRGGRCAVLSCLPKEEQIGKCSTRGRKCCRRKK

SEQ ID NO: 594 - protein, 42 aa, Hyalophora cecropia
AKIPIKAIKTVGKAVGKGLRAINIASTANDVFNFLKPKKRKA

SEQ ID NO: 595 - protein, 40 aa, Sarcophaga peregrina
ATCDLLSGTGINHSACAAHCLLRGNRGGYCNGKAVCVCRN

SEQ ID NO: 596 - protein, 83 aa, Homo sapiens
GRDYRTCLTIVQKLKKMVDKPTQRSVSNAATRVCTRGRSRWRDVCRNFMRRYQSRVIQGLVAGETAQQICEDLRLCIPSTGPL

SEQ ID NO: 597 - protein, 25 aa, Bos taurus
FKCRRWQWRMKKLGAPSITCVRRAF

SEQ ID NO: 598 - protein, 25 aa, Homo sapiens
DTHFPICIFCCGCCHRSKCGMCCKT

SEQ ID NO: 599 - protein, 15 aa, Bacillus brevis
VGALAVVVWLWLWLW

SEQ ID NO: 600 - protein, 36 aa, Pseudacanthotermes spiniger
ACNFQSCWATCQAQHSIYFRRAFCDRSQCKCVFVRG

SEQ ID NO: 601 - protein, 30 aa, Amaranthus caudatus
VGECVRGRCPSGMCCSQFGYCGKGPKYCGR

SEQ ID NO: 602 - protein, 20 aa, Bacillus sp.
CTFTLPGGGGVCTLTSECIC

SEQ ID NO: 603 - protein, 78 aa, Sus scrofa
GYFCESCRKIIQKLEDMVGPQPNEDTVTQAASQVCDKLKILRGLCKKIMRSFLRRISWDILTGKKPQAICVDIKICKE

SEQ ID NO: 604 - protein, 43 aa, Lactobacillus sake
KYYGNGVHCGKHSCTVDWGTAIGNIGNNAAANWATGGNAGWNK

SEQ ID NO: 605 - protein, 18 aa, Sus scrofa
RGGRLCYCRRRFCVCVGR

SEQ ID NO: 606 - protein, 35 aa, Bacillus subtilis
NKGCATCSIGAACLVDGPIPDFEIAGATGLFGLWG

SEQ ID NO: 607 - protein, 21 aa, Escherichia coli
VGIGTPIFSYGGGAGHVPEYF

SEQ ID NO: 608 - protein, 18 aa, Limulus polyphemus
RRWCFRVCYRGFCYRKCR

SEQ ID NO: 609 - protein, 13 aa, Opisthacanthus madagascariensis
ILGKIWEGIKSLF

SEQ ID NO: 610 - protein, 38 aa, Aptenodytes patagonicus
SFGLCRLRRGFCARGRCRFPSIPIGRCSRFVQCCRRVW

SEQ ID NO: 611 - protein, 13 aa, Litoria aurea
GLFDIIKKIAESF

SEQ ID NO: 612 - protein, 17 aa, Tachypleus tridentatus
KWCFRVCYRGICYRRCR

SEQ ID NO: 613 - protein, 33 aa, Pardachirus marmoratus
GFFALIPKIISSPLFKTLLSAVGSALSSSGGQE

SEQ ID NO: 614 - protein, 25 aa, Phytomedusa distincta
NLVSGLIEARKYLEQLHRKLKNCKV

SEQ ID NO: 615 - protein, 47 aa, Litopenaeus setiferus
HSSGYTRPLRKPSRPIFIRPIGCDVCYGIPSSTARLCCFRYGDCCHL

SEQ ID NO: 616 - protein, 26 aa, Lactobacillus plantarum
KSSAYSLQMGATAIKQVKKLFKKWGW

SEQ ID NO: 617 - protein, 25 aa, Pleuronectes americanus
GWGSFFKKAAHVGKHVGKAALTHYL

SEQ ID NO: 618 - protein, 49 aa, Homo sapiens
GRRRRSVQWCAVSQPEATKCFQWQRNMRKVRGPPVSCIKRDSPIQCIQA

SEQ ID NO: 619 - protein, 40 aa, Pseudoplectania nigrella
GFGCNGPWDEDDMQCHNHCKSIKGYKGGYCAKGGFVCKCY

SEQ ID NO: 620 - protein, 29 aa, Homo sapiens
CYCRIPACIAGERRYGTCIYQGRLWAFCC

SEQ ID NO: 621 - protein, 34 aa, Homo sapiens
VCSCRLVFCRRTELRVGNCLIGGVSFTYCCTRVD

SEQ ID NO: 622 - protein, 35 aa, Homo sapiens
QARATCYCRTGRCATRESLSGVCEISGRLYRLCCR

SEQ ID NO: 623 - protein, 35 aa, Homo sapiens
STRAFTCHCRRSCYSTEYSYGTCTVMGINHRFCCL

SEQ ID NO: 624 - protein, 25 aa, Pseudacanthotermes spiniger
HVDKKVADKVLLLKQLRIMRLLTRL

SEQ ID NO: 625 - protein, 42 aa, Stomoxys calcitrans
RGFRKHFNKLVKKVKHTISETAHVAKDTAVIAGSGAAVVAAT

SEQ ID NO: 626 - protein, 41 aa, Lactobacillus sake
ARSYGNGVYCNNKKCWVNRGEATQSIIGGMISGWASGLAGM

SEQ ID NO: 627 - protein, 43 aa, Crassostrea gigas
GFGCPGNQLKCNNHCKSISCRAGYCDAATLWLRCTCTDCNGKK

SEQ ID NO: 628 - protein, 47 aa, Bacillus subtilis
AIKLVQSPNGNFAASFVLDGTKWIFKSKYYDSSKGYWVGIYEVWDRK

SEQ ID NO: 629 - protein, 42 aa, Tachypleus tridentatus
YVSCLFRGARCRVYSGRSCCFGYYCRRDFPGSIFGTCSRRNF

SEQ ID NO: 630 - protein, 42 aa, Tachypleus tridentatus
YITCLFRGARCRVYSGRSCCFGYYCRRDFPGSIFGTCSRRNF

SEQ ID NO: 631 - protein, 31 aa, Chassalia parviflora
CGESCVFIPCISTLLGCSCKNKVCYRNGVIP

SEQ ID NO: 632 - protein, 13 aa, Artificial Sequence
  synthetic LLAA, LL-37-derived aurein 1.2 analog, retro-FK13
RLFDKIRQVIRKF

SEQ ID NO: 633 - protein, 13 aa, Artificial Sequence
  synthetic FK-13, LL-37 core peptide
FKRIVQRIKDFLR

SEQ ID NO: 634 - protein, 37 aa, Rana rugosa
GILDTLKQFAKGVGKDLVKGAAQGVLSTVSCKLAKTC

SEQ ID NO: 635 - protein, 26 aa, Lachesana tarabaevi
GLFGKLIKKFGRKAISYAVKKARGKH

SEQ ID NO: 636 - protein, 32 aa, Gallus gallus
LVQRGRFGRFLRKIRRFRPKVTITIQGSARFG

SEQ ID NO: 637 - protein, 47 aa, Vigna radiata
KTCENLANTYRGPCFTTGSCDDHCKNKEHLRSGRCRDDFRCWCTRNC

SEQ ID NO: 638 - protein, 32 aa, Mus musculus
GLLCYCRKGHCKRGERVRGTCGIRFLYCCPRR

SEQ ID NO: 639 - protein, 29 aa, Gallus gallus
RVKRFWPLVPVAINTVAAGINLYKAIRRK

SEQ ID NO: 640 - protein, 15 aa, Artificial Sequence
  synthetic CM15, shortened cecropin A-melittin hybrid
KWKLFKKIGAVLKVL

SEQ ID NO: 641 - protein, 21 aa, Arenicola marina
RWCVYAYVRIRGVLVRYRRCW

SEQ ID NO: 642 - protein, 22 aa, Morone saxatilis
FFHHIFRGIVHVGKTIHRLVTG

SEQ ID NO: 643 - protein, 39 aa, Lactococcus lactis
GTWDDIGQGIGRVAYWVGKALGNLSDVNQASRINRKKKH

SEQ ID NO: 644 - protein, 19 aa, Phyllomedusa hypochondrialis
FLSLIPHAINAVSTLVHHF

SEQ ID NO: 645 - protein, 19 aa, Phyllomedusa hypochondrialis
FLSLIPHAINAVSAIAKHN

SEQ ID NO: 646 - protein, 19 aa, Phyllomedusa hypochondrialis
FLSLIPHAINAVSALANHG

SEQ ID NO: 647 - protein, 21 aa, Arenicola marina
RWCVYAYVRVRGVLVRYRRCW

SEQ ID NO: 648 - protein, 32 aa, Rana cascadae
GILSSFKGVAKGVAKDLAGKLLETLKCKITGC

SEQ ID NO: 649 - protein, 35 aa, Cupiennius salei
GFGALFKFLAKKVAKTVAKQAAKQGAKYVVNKQME

SEQ ID NO: 650 - protein, 37 aa, Homo sapiens
LLGDFFRKSKEKIGKEFKRIVQRIKDFLRNLVPRTES

SEQ ID NO: 651 - protein, 37 aa, Leuconostoc gelidum
KYYGNGVHCTKSGCSVNWGEAFSAGVHRLANGGNGFW

SEQ ID NO: 652 - protein, 23 aa, Xenopus laevis
GIGKFLHSAKKFGKAFVGEIMNS

SEQ ID NO: 653 - protein, 26 aa, Apis mellifera
GIGAVLKVLTTGLPALISWIKRKRQQ

SEQ ID NO: 654 - protein, 26 aa, Lachesana tarabaevi
SMWSGMWRRKLKKLRNALKKKLKGEK

SEQ ID NO: 655 - protein, 30 aa, Homo sapiens
ACYCRIPACIAGERRYGTCIYQGRLWAFCC

SEQ ID NO: 656 - protein, 17 aa, Artificial Sequence
  synthetic antimicrobial peptide RP-1
ALYKKFKKKLLKSLKRL

SEQ ID NO: 657 - protein, 21 aa, Podisus maculiventris
GSKKPVPIIYCNRRTGKCQRM

SEQ ID NO: 658 - protein, 7 aa, Carnobacterium piscicola
GSEIQPR

SEQ ID NO: 659 - protein, 21 aa, Streptococcus mutans
KSWSLCTPGCARTGSFNSYCC

SEQ ID NO: 660 - protein, 37 aa, Hyas araneus
SRWPSPGRPRPFPGRPKPIFRPRPCNCYAPPCPCDRW

SEQ ID NO: 661 - protein, 25 aa, Kocuria varians
GSGVIPTISHECHMNSFQFVFTCCS

SEQ ID NO: 662 - protein, 32 aa, Bombyx mori
DLRFWNPREKLPLPTLPPFNPKPIYIDMGNRY

SEQ ID NO: 663 - protein, 34 aa, Drosophila mauritana
VFIDILDKMENAIHKAAQAGIGIAKPIEKMILPK

SEQ ID NO: 664 - protein, 36 aa, Ceratitis capitata
SIGTAVKKAVPIAKKVGKVAIPIAKAVLSVVGQLVG

SEQ ID NO: 665 - protein, 31 aa, Styela clava
GWFGKAFRSVSNFYKKHKTYIHAGLSAATLL

SEQ ID NO: 666 - protein, 32 aa, Styela clava
GWLRKAAKSVGKFYYKHKYYIKAAWQIGKHAL

SEQ ID NO: 667 - protein, 32 aa, Styela clava
GWLRKAAKSVGKFYYKHKYYIKAAWKIGRHAL

SEQ ID NO: 668 - protein, 27 aa, Streptococcus mutans
NRWWQGVVPTVSYECRMNSWQHVFTCC

SEQ ID NO: 669 - protein, 38 aa, Mesembryanthemum crystallinum
AKCIKNGKGCREDQGPPFCCSGFCYRQVGWARGYCKNR

SEQ ID NO: 670 - protein, 42 aa, Bombyx mori
AKIPIKAIKTVGKAVGKGLRAINIASTANDVFNFLKPKKRKH

SEQ ID NO: 671 - protein, 13 aa, Homo sapiens
SYSMEHFRWGKPV

SEQ ID NO: 672 - protein, 33 aa, Orychtolagus cuniculus
VVCACRRALCLPRERRAGFCRIRGRIHPLCCRR

SEQ ID NO: 673 - protein, 33 aa, Orychtolagus cuniculus
VVCACRRALCLPLERRAGFCRIRGRIHPLCCRR

SEQ ID NO: 674 - protein, 24 aa, Bombina variegata
GIGALSAKGALKGLAKGLAEHFAN

SEQ ID NO: 675 - protein, 37 aa, Hyalophora cecropia
KWKLFKKIEKVGQNIRDGIIKAGPAVAVVGQATQIAK

SEQ ID NO: 676 - protein, 35 aa, Antheraea pernyi
KWKIFKKIEKVGRNIRNGIIKAGPAVAVLGEAKAL

SEQ ID NO: 677 - protein, 36 aa, Antheraea pernyi
WNPFKELERAGQRVRDAIISAGPAVATVAQATALAK

SEQ ID NO: 678 - protein, 13 aa, Vespa crabro
FLPLILRKIVTAL

SEQ ID NO: 679 - protein, 35 aa, Bombyx mori
RWKIFKKIEKMGRNIRDGIVKAGPAIEVLGSAKAI

SEQ ID NO: 680 - protein, 14 aa, Vespa mandarinia
INLKAIAALAKKLL

SEQ ID NO: 681 - protein, 47 aa, Bos taurus
SDEKASPDKHHRFSLSRYAKLANRLANPKLLETFLSKWIGDRGNRSV

SEQ ID NO: 682 - protein, 33 aa, Orychtolagus cuniculus
VFCTCRGFLCGSGERASGSCTINGVRHTLCCRR

SEQ ID NO: 683 - protein, 33 aa, Orychtolagus cuniculus
VSCTCRRFSCGFGERASGSCTVNGVRHTLCCRR

SEQ ID NO: 684 - protein, 34 aa, Orychtolagus cuniculus
GRCVCRKQLLCSYRERRIGDCKIRGVRFPFCCPR

SEQ ID NO: 685 - protein, 33 aa, Orychtolagus cuniculus
ICACRRRFCPNSERFSGYCRVNGARYVRCCSRR

SEQ ID NO: 686 - protein, 34 aa, Orychtolagus cuniculus
GICACRRRFCPNSERFSGYCRVNGARYVRCCSRR

SEQ ID NO: 687 - protein, 17 aa, Megabombus pennsylvanicus
SKITDILAKLGKVLAHV

SEQ ID NO: 688 - protein, 17 aa, Megabombus pennsylvanicus
IKIMDILAKLGKVLAHV

SEQ ID NO: 689 - protein, 17 aa, Megabombus pennsylvanicus
INIKDILAKLVKVLGHV

SEQ ID NO: 690 - protein, 17 aa, Megabombus pennsylvanicus
INVLGILGLLGKALSHL

SEQ ID NO: 691 - protein, 47 aa, Pyrularia pubera
KSCCRNTWARNCYNVCRLPGTISREICAKKCDCKIISGTTCPSDYPK

SEQ ID NO: 692 - protein, 39 aa, Sarcophaga peregrina
GWLKKIGKKIERVGQHTRDATIQGLGIAQQAANVAATAR

SEQ ID NO: 693 - protein, 39 aa, Sarcophaga peregrina
GWLKKIGKKIERVGQHTRDATIQVIGVAQQAANVAATAR

SEQ ID NO: 694 - protein, 39 aa, Sarcophaga peregrina
GWLRKIGKKIERVGQHTRDATIQVLGIAQQAANVAATAR

SEQ ID NO: 695 - protein, 17 aa, Megabombus pennsylvanicus
IKITTMLAKLGKVLAHV

SEQ ID NO: 696 - protein, 32 aa, Bacillus subtilis
WKSESLCTPGCVTGALQTCFLQTLTCNCKISK

SEQ ID NO: 697 - protein, 35 aa, Mus musculus
LRDLVCYCRARGCKGRERMNGTCRKGHLLYMLCCR

SEQ ID NO: 698 - protein, 34 aa, Lactococcus lactis
ITSISLCTPGCKTGALMGCNMKTATCHCSIHVSK

SEQ ID NO: 699 - protein, 17 aa, Tachypleus tridentatus
RWCFRVCYRGICYRKCR

SEQ ID NO: 700 - protein, 18 aa, Limulus polyphemus
RRWCFRVCYKGFCYRKCR

SEQ ID NO: 701 - protein, 31 aa, Ascaris suum
SWLSKTAKKLENSAKKRISEGIAIAIQGGPR

SEQ ID NO: 702 - protein, 37 aa, Manduca sexta
WNPFKELERAGQRVRDAVISAAPAVATVGQAAAIARG

SEQ ID NO: 703 - protein, 37 aa, Manduca sexta
WNPFKELERAGQRVRDAIISAGPAVATVGQAAAIARG

SEQ ID NO: 704 - protein, 37 aa, Manduca sexta
WNPFKELERAGQRVRDAIISAAPAVATVGQAAAIARG

SEQ ID NO: 705 - protein, 36 aa, Manduca sexta
WNPFKELERAGQRVRDAVISAAAVATVGQAAAIARG

SEQ ID NO: 706 - protein, 35 aa, Hyalophora cecropia
RWKIFKKIEKVGQNIRDGIVKAGPAVAVVGQAATI

SEQ ID NO: 707 - protein, 34 aa, Apis mellifera
YVPLPNVPQPGRRPFPTFPGQGPFNPKIKWPQGY

SEQ ID NO: 708 - protein, 24 aa, Homo sapiens
DSHAKRHHGYKRKFHEKHHSHRGY

SEQ ID NO: 709 - protein, 32 aa, Homo sapiens
DSHAKRHHGYKRKFHEKHHSHRGYRSNYLYDN

SEQ ID NO: 710 - protein, 12 aa, Homo sapiens
KFHEKHHSHRGY

SEQ ID NO: 711 - protein, 51 aa, Apis mellifera
VTCDLLSFKGQVNDSACAANCLSLGKAGGHCEKVGCICRKTSFKDLWDKRF

SEQ ID NO: 712 - protein, 17 aa, Tachypleus gigas
KWCFRVCYRGICYRKCR

SEQ ID NO: 713 - protein, 40 aa, Sarcophaga peregrina
GWIRDFGKRIERVGQHTRDATIQTIAVAQQAANVAATLKG

SEQ ID NO: 714 - protein, 34 aa, Staphylococcus epidermidis
TAGPAIRASVKQCQKTLKATRLFTVSCKGKNGCK

SEQ ID NO: 715 - protein, 43 aa, Bos taurus
RFRPPIRRPPIRPPFYPPFRPPIRPPIFPPIRPPFRPPLGPFP

SEQ ID NO: 716 - protein, 60 aa, Bos taurus
RRIRPRPPRLPRPRPRPLPFPRPGPRPIPRPLPFPRPGPRPIPRPLPFPRPGPRPIPRPL

SEQ ID NO: 717 - protein, 14 aa, Vespa basalis
LKLKSIVSWAKKVL

SEQ ID NO: 718 - protein, 34 aa, Drosophila melanogaster
VFIDILDKVENAIHNAAQVGIGFAKPFEKLINPK

SEQ ID NO: 719 - protein, 12 aa, Bos taurus
RLCRIVVIRVCR

SEQ ID NO: 720 - protein, 37 aa, Lactobacillus sake
STPVLASVAVSMELLPTASVLYSDVAGCFKYSAKHHC

SEQ ID NO: 721 - protein, 25 aa, Xenopus laevis
GWASKIGQTLGKIAKVGLKELIQPK

SEQ ID NO: 722 - protein, 38 aa, Bos taurus
NPVSCVRNKGICVPIRCPGSMKQIGTCVGRAVKCCRKK

SEQ ID NO: 723 - protein, 37 aa, Orychtolagus cuniculus
GLRKRLRKFRNKIKEKLKKIGQKIQGFVPKLAPRTDY

SEQ ID NO: 724 - protein, 37 aa, Mirabilis jalapa
QCIGNGGRCNENVGPPYCCSGFCLRQPGQGYGYCKNR

SEQ ID NO: 725 - protein, 36 aa, Mirabilis jalapa
CIGNGGRCNENVGPPYCCSGFCLRQPNQGYGVCRNR

SEQ ID NO: 726 - protein, 35 aa, Mus musculus
LRDLVCYCRKRGCKRRERMNGTCRKGHLMYTLCCR

SEQ ID NO: 727 - protein, 33 aa, Zea mays
RSGRGECRRQCLRRHEGQPWETQECMRRCRRRG

SEQ ID NO: 728 - protein, 27 aa, Bombina orientalis
GIGASILSAGKSALKGLAKGLAEHFAN

SEQ ID NO: 729 - protein, 27 aa, Bombina orientalis
GIGSAILSAGKSALKGLAKGLAEHFAN

SEQ ID NO: 730 - protein, 25 aa, Bombina orientalis
GIGAAILSAGKSALKGLAKGLAEHF

SEQ ID NO: 731 - protein, 25 aa, Bombina orientalis
GIGAAILSAGKSIIKGLANGLAEHF

SEQ ID NO: 732 - protein, 27 aa, Pediococcus acidilactici
KYYGNGVTCGKHSCSVDWGKATTCIIN

SEQ ID NO: 733 - protein, 34 aa, Lactococcus lactis
ITSISLCTPGCKTGALMGCNMKTATCNCSIHVSK

SEQ ID NO: 734 - protein, 39 aa, Drosophila melanogaster
GWLKKLGKRIERIGQHTRDATIQGLGIAQQAANVAATAR

SEQ ID NO: 735 - protein, 33 aa, Phyllomedusa bicolor
GLWSKIKEVGKEAAKAAAKAAGKAALGAVSEAV

SEQ ID NO: 736 - protein, 34 aa, Sarcophaga peregrina
LTCEIDRSLCLLHCRLKGYLRAYCSQQKVCRCVQ

SEQ ID NO: 737 - protein, 40 aa, Sarcophaga peregrina
ATCDLLSGIGVQHSACALHCVFRGNRGGYCTGKGICVCRN

SEQ ID NO: 738 - protein, 16 aa, Sus scrofa
RGGRLCYCRRRFCICV

SEQ ID NO: 739 - protein, 18 aa, Sus scrofa
RGGGLCYCRRRFCVCVGR

SEQ ID NO: 740 - protein, 24 aa, Rana esculenta
FLPLLAGLAANFLPKIFCKITRKC

SEQ ID NO: 741 - protein, 46 aa, Rana esculenta
GIFSKLGRKKIKNLLISGLKNVGKEVGMDVVRTGIDIAGCKIKGEC

SEQ ID NO: 742 - protein, 24 aa, Rana brevipoda
FLPVLAGIAAKVVPALFCKITKKC

SEQ ID NO: 743 - protein, 33 aa, Rana brevipoda
GLLDSLKGFAATAGKGVLQSLLSTASCKLAKTC

SEQ ID NO: 744 - protein, 38 aa, Macaca fascicularis
DSHEERHHGRHGHHKYGRKFHEKHHSHRGYRSNYLYDN

SEQ ID NO: 745 - protein, 18 aa, Apis mellifera
GNNRPVYIPQPRPPHPRI

SEQ ID NO: 746 - protein, 18 aa, Apis mellifera
GNNRPVYIPQPRPPHPRL

SEQ ID NO: 747 - protein, 29 aa, Ceratitis capitata
SIGSALKKALPVAKKIGKIALPIAKAALP

SEQ ID NO: 748 - protein, 29 aa, Ceratitis capitata
SIGSAFKKALPVAKKIGKAALPIAKAALP

SEQ ID NO: 749 - protein, 19 aa, Drosophila melanogaster
GKPRPYSPRPTSHPRPIRV

SEQ ID NO: 750 - protein, 20 aa, Pyrrhocoris apterus
VDKGSYLPRPTPPRPIYNRN

SEQ ID NO: 751 - protein, 37 aa, Leuconostoc mesenteroides
KYYGNGVHCTKSGCSVNWGEAASAGIHRLANGGNGFW

SEQ ID NO: 752 - protein, 43 aa, Carnobacterium piscicola
AISYGNGVYCNKEKCWVNKAENKQAITGIVIGGWASSLAGMGH

SEQ ID NO: 753 - protein, 24 aa, Xenopus laevis
GVLSNVIGYLKKLGTGALNAVLKQ

SEQ ID NO: 754 - protein, 20 aa, Rana catesbeiana
FLGGLIKIVPAMICAVTKKC

SEQ ID NO: 755 - protein, 24 aa, Rana esculenta
FLPAIFRMAAKVVPTIICSITKKC

SEQ ID NO: 756 - protein, 23 aa, Rana esculenta
VIPFVASVAAEMQHVYCAASRKC

SEQ ID NO: 757 - protein, 33 aa, Rana esculenta
GILDTLKNLAISAAKGAAQGLVNKASCKLSGQC

SEQ ID NO: 758 - protein, 33 aa, Rana esculenta
GILDTLKNLAKTAGKGALQGLVKMASCKLSGQC

SEQ ID NO: 759 - protein, 34 aa, Rana esculenta
GILLDKLKNFAKTAGKGVLQSLLNTASCKLSGQC

SEQ ID NO: 760 - protein, 29 aa, Rana esculenta
GILDSLKNLAKNAGQILLNKASCKLSGQC

SEQ ID NO: 761 - protein, 46 aa, Rana esculenta
GIFSKLAGKKIKNLLISGLKNVGKEVGMDVVRTGIDIAGCKIKGEC

SEQ ID NO: 762 - protein, 46 aa, Rana esculenta
GIFSKLAGKKLKNLLISGLKNVGKEVGMDVVRTGIDIAGCKIKGEC

SEQ ID NO: 763 - protein, 37 aa, Rana esculenta
GILSLVKGVAKLAGKGLAKEGGKFGLELIACKIAKQC

SEQ ID NO: 764 - protein, 37 aa, Rana esculenta
GIFSLVKGAAKLAGKGLAKEGGKFGLELIACKIAKQC

SEQ ID NO: 765 - protein, 39 aa, Gallus gallus
GRKSDCFRKSGFCAFLKCPSLTLISGKCSRFYLCCKRIW

SEQ ID NO: 766 - protein, 39 aa, Gallus gallus
GRKSDCFRKNGFCAFLKCPYLTLISGKCSRFHLCCKRIW

SEQ ID NO: 767 - protein, 36 aa, Gallus gallus
LFCKGGSCHFGGCPSHLIKVGSCFGFRSCCKWPWNA

SEQ ID NO: 768 - protein, 40 aa, Bos taurus
VRNHVTCRINRGFCVPIRCPGRTRQIGTCFGPRIKCCRSW

SEQ ID NO: 769 - protein, 42 aa, Bos taurus
QGVRNHVTCRINRGFCVPIRCPGRTRQIGTCFGPRIKCCRSW

SEQ ID NO: 770 - protein, 41 aa, Bos taurus
QRVRNPQSCRWNMGVCIPFLCRVGMRQIGTCFGPRVPCCRR

SEQ ID NO: 771 - protein, 42 aa, Bos taurus
QVVRNPQSCRWNMGVCIPISCPGNMRQIGTCFGPRVPCCRRW

SEQ ID NO: 772 - protein, 42 aa, Bos taurus
QGVRNHVTCRIYGGFCVPIRCPGRTRQIGTCFGRPVKCCRRW

SEQ ID NO: 773 - protein, 40 aa, Bos taurus
QGVRNFVTCRINRGFCVPIRCPGHRRQIGTCLGPRIKCCR

SEQ ID NO: 774 - protein, 38 aa, Bos taurus
VRNFVTCRINRGFCVPIRCPGHRRQIGTCLGPQIKCCR

SEQ ID NO: 775 - protein, 40 aa, Bos taurus
QGVRNFVTCRINRGFCVPIRCPGHRRQIGTCLAPQIKCCR

SEQ ID NO: 776 - protein, 40 aa, Bos taurus
QGVRSYLSCWGNRGICLLNRCPGRMRQIGTCLAPRVKCCR

SEQ ID NO: 777 - protein, 38 aa, Bos taurus
GPLSCRRNGGVCIPIRCPGPMRQIGTCFGRPVKCCRSW

SEQ ID NO: 778 - protein, 42 aa, Bos taurus
SGISGPLSCGRNGGVCIPIRCPVPMRQIGTCFGRPVKCCRSW

SEQ ID NO: 779 - protein, 37 aa, Bombyx mori
PWNIFKEIERAVARTRDAVISAGPAVRTVAAATSVAS

SEQ ID NO: 780 - protein, 30 aa, Cavia porcellus
RCICTTRTCRFPYRRLGTCLFQNRVYTFCC

SEQ ID NO: 781 - protein, 23 aa, Sus scrofa
RIIDLLWRVRRPQKPKFVTVWVR

SEQ ID NO: 782 - protein, 37 aa, Sus scrofa
VGRFRRLRKKTRKRLKKIGKVLKWIPPIVGSIPLGCG

SEQ ID NO: 783 - protein, 37 aa, Sus scrofa
GLLSRLRDFLSDRGRRLGEKIERIGQKIKDLSEFFQS

SEQ ID NO: 784 - protein, 18 aa, Sus scrofa
RGGRLCYCRGWICFCVGR

SEQ ID NO: 785 - protein, 18 aa, Hyphantria cunea
RGGRLCYCRPRFCVCVGR

SEQ ID NO: 786 - protein, 35 aa, Hyphantria cunea
RWKIFKKIERVGQNVRDGIIKAGPAIQVLGTAKAL

SEQ ID NO: 787 - protein, 35 aa, Hyphantria cunea
RWKFFKKIERVGQNVRDGLIKAGPAIQVLGAAKAL

SEQ ID NO: 788 - protein, 35 aa, Hyphantria cunea
RWKVFKKIEKVGRNIRDGVIKAGPAIAVVGQAKAL

SEQ ID NO: 789 - protein, 35 aa, Hyphantria cunea
RWKVFKKIEKVGRHIRDGVIKAGPAITVVGQATAL

SEQ ID NO: 790 - protein, 34 aa, Mus musculus
GLLRKGGEKIGEKLKKIGQKIKNFFQKLVPQPEQ

SEQ ID NO: 791 - protein, 27 aa, Bos taurus
GRFKRFRKKFKKLFKKLSPVIPLLHLG

SEQ ID NO: 792 - protein, 28 aa, Bos taurus
GGLRSLGRKILRAWKKYGPIIVPIIRIG

SEQ ID NO: 793 - protein, 12 aa, Ovis aries
RICRIIFLRVCR

SEQ ID NO: 794 - protein, 32 aa, Bombyx mori
DLRFLYPRGKLPVPTPPPFNPKPIYIDMGNRY

SEQ ID NO: 795 - protein, 32 aa, Bombyx mori
DLRFLYPRGKLPVPTLPPFNPKPIYIDMGNRY

SEQ ID NO: 796 - protein, 39 aa, Bufo gargarisans
AGRGKQGGKVRAKAKTRSSRAGLQFPVGRVHRLLRKGNY

SEQ ID NO: 797 - protein, 21 aa, Bufo gargarisans
TRSSRAGLQFPVGRVHRLLRK

SEQ ID NO: 798 - protein, 25 aa, Litoria caerulea
GLLSVLGSVAKHVLPHVVPVIAEHL

SEQ ID NO: 799 - protein, 25 aa, Litoria caerulea
GLLGVLGSVAKHVLPHVVPVIAEHL

SEQ ID NO: 800 - protein, 25 aa, Litoria caerulea
GLLSVLGSVAQHVLPHVVPVIAEHL

SEQ ID NO: 801 - protein, 25 aa, Litoria caerulea
GLLSSLSSVAKHVLPHVVPVIAEHL

SEQ ID NO: 802 - protein, 25 aa, Litoria caerulea
GLLSVLGSVVKHVIPHVVPVIAEHL

SEQ ID NO: 803 - protein, 24 aa, Litoria chloris
GLFSVLGAVAKHVLPHVVPVIAEK

SEQ ID NO: 804 - protein, 24 aa, Litoria chloris
GLFKVLGSVAKHLLPHVAPVIAEK

SEQ ID NO: 805 - protein, 25 aa, Litoria splendida
GLVSSIGRALGGLLADVVKSKGQPA

SEQ ID NO: 806 - protein, 25 aa, Litoria splendida
GLVSSIGRALGGLLADVVKSKEQPA

SEQ ID NO: 807 - protein, 25 aa, Litoria caerulea
GLVSSIGKALGGLLADVVKTKEQPA

SEQ ID NO: 808 - protein, 25 aa, Litoria caerulea
GLVSSIGRALGGLLADVVKSKEQPA

SEQ ID NO: 809 - protein, 22 aa, Litoria splendida
GLWQKIKDKASELVSGIVEGVK

SEQ ID NO: 810 - protein, 22 aa, Litoria caerulea
GLWEKIKEKASELVSGIVEGVK

SEQ ID NO: 811 - protein, 22 aa, Litoria caerulea
GLWEKIKEKANELVSGIVEGVK

SEQ ID NO: 812 - protein, 22 aa, Litoria caerulea
GLWEKIREKANELVSGIVEGVK

SEQ ID NO: 813 - protein, 23 aa, Litoria caerulea
GLWQKIKSAAGDLASGIVEGIKS

SEQ ID NO: 814 - protein, 23 aa, Litoria caerulea
GLWQKIKSAAGDLASGIVEAIKS

SEQ ID NO: 815 - protein, 23 aa, Litoria caerulea
GLWQKIKNAAGDLASGIVEGIKS

SEQ ID NO: 816 - protein, 20 aa, Litoria infrafrenata
GLMSVLGHAVGNVLGGLFKS

SEQ ID NO: 817 - protein, 37 aa, Mus musculus
DQYKCLQHGGFCLRSSCPSNTKLQGTCKPDKPNCCKS

SEQ ID NO: 818 - protein, 34 aa, Bos taurus
GLFRRLRDSIRRGQQKILEKARRIGERIKDIFRG

SEQ ID NO: 819 - protein, 34 aa, Androctonus australis
SIVPIRCRSNRDCRRFCGFRGGRCTYARQCLCGY

SEQ ID NO: 820 - protein, 31 aa, Psychotria longipes
SIPCGESCVFIPCTVTALLGCSCKSKVCYKN

SEQ ID NO: 821 - protein, 13 aa, Rana temporaria
FLPLIGRVLSGIL

SEQ ID NO: 822 - protein, 13 aa, Rana temporaria
LLPILGNLLNGLL

SEQ ID NO: 823 - protein, 13 aa, Rana temporaria
VLPIIGNLLNSLL

SEQ ID NO: 824 - protein, 13 aa, Rana temporaria
FLPLIGKVLSGIL

SEQ ID NO: 825 - protein, 10 aa, Rana temporaria
LLPNLLKSLL

SEQ ID NO: 826 - protein, 46 aa, Equus caballus
EVERKHPLGGSRPGRCPTVPPGTFGHCACLCTGDASEPKGQKCCSN

SEQ ID NO: 827 - protein, 13 aa, Rana temporaria
FVQWFSKFLGRIL

SEQ ID NO: 828 - protein, 13 aa, Rana temporaria
LLPIVGNLLKSLL

SEQ ID NO: 829 - protein, 13 aa, Rana temporaria
FFPVIGRILNGIL

SEQ ID NO: 830 - protein, 74 aa, Zophobas atratus
SLQGGAPNFPQPSQQNGGWQVSPDLGRDDKGNTRGQIEIQNKGKDHDFNAGWGKVIRGPNKAKPTWHVGGTYRR

SEQ ID NO: 831 - protein, 39 aa, Sus scrofa
RRRPRPPYLPRPRPPPFFPPRLPPRIPPGFPPRFPPRFP

SEQ ID NO: 832 - protein, 38 aa, Aeschna cyanea
GFGCPLDQMQCHRHCQTITGRSGGYCSGPLKLTCTCYR

SEQ ID NO: 833 - protein, 34 aa, Oryctolagus cuniculus
GICACRRRFCLNFEQFSGYCRVNGARYVRCCSRR

SEQ ID NO: 834 - protein, 32 aa, Sus scrofa
RADTQTYQPYNKDWIKEKIYVLLRRQAQQAGK

SEQ ID NO: 835 - protein, 34 aa, Phyllomedusa sauvagei
ALWKTMLKKLGTMALHAGKAALGAAADTISQGTQ

SEQ ID NO: 836 - protein, 34 aa, Phyllomedusa sauvagei
ALWFTMLKKLGTMALHAGKAALGAAANTISQGTQ

SEQ ID NO: 837 - protein, 30 aa, Phyllomedusa sauvagei
ALWKNMLKGIGKLAGKAALGAVKKLVGAES

SEQ ID NO: 838 - protein, 27 aa, Phyllomedusa sauvagei
ALWMTLLKKVLKAAAKALNAVLVGANA

SEQ ID NO: 839 - protein, 29 aa, Phyllomedusa sauvagei
GLWSKIKTAGKSVAKAAAKAAVKAVTNAV

SEQ ID NO: 840 - protein, 31 aa, Phyllomedusa bicolor
AMWKDVLKKIGTVALHAGKAALGAVADTISQ

SEQ ID NO: 841 - protein, 39 aa, Gallus gallus
GRKSDCFRKSGFCAFLKCPSLTLISGKCSRFYLCCKRIR

SEQ ID NO: 842 - protein, 33 aa, Gallus gallus
GRKSDCFRKNGFCAFLKCPYLTLISGLCSFHLC

SEQ ID NO: 843 - protein, 35 aa, Meleagris gallopavo
GKREKCLRRNGFCAFLKCPTLSVISGTCSRFQVCC

SEQ ID NO: 844 - protein, 36 aa, Meleagris gallopavo
LFCKRGTCHFGRCPSHLIKVGSCFGFRSCCKWPWDA

SEQ ID NO: 845 - protein, 25 aa, Meleagris gallopavo
LSCKRGTCHFGRCPSHLIKGSCSGG

SEQ ID NO: 846 - protein, 33 aa, Rana rugosa
SLFSLIKAGAKFLGKNLLKQGACYAACKASKQC

SEQ ID NO: 847 - protein, 33 aa, Rana rugosa
GIMSIVKDVAKNAAKEAAKGALSTLSCKLAKTC

SEQ ID NO: 848 - protein, 33 aa, Rana rugosa
GIMSIVKDVAKTAAKEAAKGALSTLSCKLAKTC

SEQ ID NO: 849 - protein, 24 aa, Rana rugosa
FLGALFKVASKVLPSVFCAITKKC

SEQ ID NO: 850 - protein, 24 aa, Rana rugosa
FLPLLAGLAANFLPTIICKISYKC

SEQ ID NO: 851 - protein, 15 aa, Rana rugosa
VDKPDYRPRPRPPNM

SEQ ID NO: 852 - protein, 15 aa, Rana rugosa
VDKPDYRPRPWPRPN

SEQ ID NO: 853 - protein, 16 aa, Palomena prasina
VDKPDYRPRPWPRNMI

SEQ ID NO: 854 - protein, 16 aa, Palomena prasina
VDKPDYRPRPWPRPNM

SEQ ID NO: 855 - protein, 44 aa, Carnobacterium piscicola
KYYGNGVSCNKNGCTVDWSKAIGIIGNNAAANLTTGGAAGWNKG

SEQ ID NO: 856 - protein, 22 aa, Streptococcus mutans
FKSWSFCTPGCAKTGSFNSYCC

SEQ ID NO: 857 - protein, 23 aa, Styela clava
VFQFLGKIIHHVGNFVHGFSHVF

SEQ ID NO: 858 - protein, 23 aa, Styela clava
VFQFLGRIIHHVGNFVHGFSHVF

SEQ ID NO: 859 - protein, 23 aa, Styela clava
VFHLLGKIIHHVGNFVYGFSHVF

SEQ ID NO: 860 - protein, 23 aa, Styela clava
AFKLLGRIIHHVGNFVYGFSHVF

SEQ ID NO: 861 - protein, 23 aa, Styela clava
LFKLLGKIIHHVGNFVHGFSHVF

SEQ ID NO: 862 - protein, 44 aa, Equus caballus
DVQCGEGHFCHDQTCCRASQGGACCPYSQGVCCADQRHCCPVGF

SEQ ID NO: 863 - protein, 36 aa, Phyllomedusa bicolor
YPPKPESPGEDASPEEMNKYLTALRHYINLVTRQRY

SEQ ID NO: 864 - protein, 33 aa, Rana rugosa
GLLNTFKDWAISIAKGAGKGVLTTLSCKLDKSC

SEQ ID NO: 865 - protein, 33 aa, Rana rugosa
SLFSLIKAGAKFLGKNLLKQGAQYAACKVSKEC

SEQ ID NO: 866 - protein, 37 aa, Rana rugosa
GILDSFKQFAKGVGKDLIKGAAQGVLSTMSCKLAKTC

SEQ ID NO: 867 - protein, 50 aa, Litopenaeus vannamei
YRGGYTGPIPRPPPIGRPPLRLVVCACYRLSVSDARNCCIKFGSCCHLVK

SEQ ID NO: 868 - protein, 50 aa, Litopenaeus vannamei
YRGGYTGPIPRPPPIGRPPFRPVCNACYRLSVSDARNCCIKFGSCCHLVK

SEQ ID NO: 869 - protein, 62 aa, Litopenaeus vannamei
QVYKGGYTRPIPRPPPFVRPLPGGPIGPYNGCPVSCRGISFSQARSCCSRLGRCCHVGKGYS

SEQ ID NO: 870 - protein, 24 aa, Litoria chloris
GLFKVLGSVAKHLLPHVVPVIAEK

SEQ ID NO: 871 - protein, 24 aa, Litoria chloris
GLFGVLGSIAKHVLPHVVPVIAEK

SEQ ID NO: 872 - protein, 35 aa, Aedes albopictus
GGLKKLGKKLEGVGKRVFKASEKALPVAVGIKALG

SEQ ID NO: 873 - protein, 16 aa, Myrmecia gulosa
GRPNPVNTKPTPYPRL

SEQ ID NO: 874 - protein, 16 aa, Myrmecia gulosa
GRPNPVNNKPTPHPRL

SEQ ID NO: 875 - protein, 47 aa, Vicia faba
LLGRCKVKSNRFHGPCLTDTHCSTVCRGEGYKGGDCHGLRRRCMCLC

SEQ ID NO: 876 - protein, 47 aa, Vicia faba
LLGRCKVKSNRFNGPCLTDTHCSTVCRGEGYKGGDCHGLRRRCMCLC

SEQ ID NO: 877 - protein, 39 aa, Bombus pascuorum
FVPYNPPRPYQSKPFPSFPGHGPFNPKIQWPYPLPNPGH

SEQ ID NO: 878 - protein, 17 aa, Bombus pascuorum
GNRPVYIPPPRPPHPRL

SEQ ID NO: 879 - protein, 33 aa, Mesocricetus auratus
VTCFCRRRGCASRERHIGYCRFGNTIYRLCCRR

SEQ ID NO: 880 - protein, 31 aa, Mesocricetus auratus
CFCKRPVCDSGETQIGYCRLGNTFYRLCCRQ

SEQ ID NO: 881 - protein, 33 aa, Mesocricetus auratus
VTCFCRRRGCASRERLIGYCRFGNTIYGLCCRR

SEQ ID NO: 882 - protein, 33 aa, Mesocricetus auratus
VTCFCKRPVCDSGETQIGYCRLGNTFYRLCCRQ

SEQ ID NO: 883 - protein, 19 aa, Styela clava
GFGKAFHSVSNFAKKHKTA

SEQ ID NO: 884 - protein, 19 aa, Styela clava
GFGPAFHSVSNFAKKHKTA

SEQ ID NO: 885 - protein, 21 aa, Misgurnus anguilicaudatus
RQRVEELSKFSKKGAAARRRK

SEQ ID NO: 886 - protein, 29 aa, Phyllomedusa bicolor
ALWKNMLKGIGKLAGQAALGAVKTLVGAE

SEQ ID NO: 887 - protein, 28 aa, Phyllomedusa bicolor
ALWKDILKNVGKAAGKAVLNTVTDMVNQ

SEQ ID NO: 888 - protein, 26 aa, Phyllomedusa bicolor
GLWNKIKEAASKAAGKAALGFVNEMV

SEQ ID NO: 889 - protein, 30 aa, Phyllomedusa bicolor
ALWKTIIKGAGKMIGSLAKNLLGSQAQPES

SEQ ID NO: 890 - protein, 19 aa, Phyllomedusa bicolor
GWMSKIASGIGTFLSGMQQ

SEQ ID NO: 891 - protein, 24 aa, Spinacia oleracea
MFFSSKKCKTVSKTFRGPCVRNAN

SEQ ID NO: 892 - protein, 23 aa, Spinacia oleracea
MFFSSKKCKTVSKTFRGPCVRNA

SEQ ID NO: 893 - protein, 25 aa, Spinacia oleracea
GIFSSRKCKTVSKTFRGICTRNANC

SEQ ID NO: 894 - protein, 21 aa, Spinacia oleracea
TCESPSHKFKGPCATNRNCES

SEQ ID NO: 895 - protein, 38 aa, Spinacia oleracea
GIFSSRKCKTPSKTFKGYCTRDSNCDTSCRYEGYPAGD

SEQ ID NO: 896 - protein, 41 aa, Pharbitis nil
QQCGRQASGRLCGNRLCCSQWGYCGSTASYCGAGCQSQCRS

SEQ ID NO: 897 - protein, 71 aa, Acalolepta luxuriosa
SLQPGAPNVNNKDQPWQVSPHISRDDSGNTRTDINVQRHGENNDFEAGWSKVVRGPNKAKPTWHIGGTHRW

SEQ ID NO: 898 - protein, 47 aa, Homo sapiens
SSLLEKGLDGAKKAVGGLGKLGKDAVEDLESVGKGAVHDVKDVLDSV

SEQ ID NO: 899 - protein, 34 aa, Mytilus edulis
GCASRCKAKCAGRRCKGWASASFRGRCYCKCFRC

SEQ ID NO: 900 - protein, 34 aa, Mytilus edulis
SCASRCKGHCRARRCGYYVSVLYRGRCYCKCLRC

SEQ ID NO: 901 - protein, 22 aa, Morone saxatilis
FFHHIFRGIVHVGKTIHKLVTG

SEQ ID NO: 902 - protein, 16 aa, Litoria citropa
GLFDVIKKVASVIGGL

SEQ ID NO: 903 - protein, 16 aa, Litoria citropa
GLFDIIKKVASVVGGL

SEQ ID NO: 904 - protein, 16 aa, Litoria citropa
GLFDIIKKVASVIGGL

SEQ ID NO: 905 - protein, 19 aa, Oncorhynchus mykiss
PDPAKTAPKKGSKKAVTKA

SEQ ID NO: 906 - protein, 43 aa, Capra hircus
RFRPPIRRPPIRPPFNPPFRPPVRPPFRPPFRPPFRPPIGPFP

SEQ ID NO: 907 - protein, 19 aa, Uperoleia inundata
GIVDFAKKVVGGIRNALGI

SEQ ID NO: 908 - protein, 19 aa, Uperoleia inundata
GFVDLAKKVVGGIRNALGI

SEQ ID NO: 909 - protein, 19 aa, Uperoleia inundata
GFFDLAKKVVGGIRNALGI

SEQ ID NO: 910 - protein, 19 aa, Uperoleia inundata
GILDFAKTVVGGIRNALGI

SEQ ID NO: 911 - protein, 19 aa, Uperoleia inundata
GIVDFAKGVLGKIKNVLGI

SEQ ID NO: 912 - protein, 17 aa, Uperoleia inundata
GVLDAFRKIATVVKNVV

SEQ ID NO: 913 - protein, 17 aa, Uperoleia inundata
GVGSFIHKVVSAIKNVA

SEQ ID NO: 914 - protein, 19 aa, Uperoleia inundata
GIIDIAKKLVGGIRNVLGI

SEQ ID NO: 915 - protein, 19 aa, Uperoleia inundata
GILDVAKTLVGKLRNVLGI

SEQ ID NO: 916 - protein, 17 aa, Uperoleia inundata
GVGDLIRKAVSVIKNIV

SEQ ID NO: 917 - protein, 17 aa, Uperoleia inundata
GVIDAAKKVVNVLKNLP

SEQ ID NO: 918 - protein, 13 aa, Litoria ewingi
GWFDVVKHIASAV

SEQ ID NO: 919 - protein, 22 aa, Litoria genimaculate
GLFVGVLAKVAAHVVPAIAEHF

SEQ ID NO: 920 - protein, 23 aa, Litoria genimaculate
GLFVGLAKVAAHNNPAIAEHFQA

SEQ ID NO: 921 - protein, 18 aa, Litoria genimaculate
GFVDFLKKVAGTIANVVT

SEQ ID NO: 922 - protein, 26 aa, Litoria genimaculate
GLLQTIKEKLESLESLAKGIVSGIQA

SEQ ID NO: 923 - protein, 25 aa, Litoria splendida
GLLSVLGSVAKHVLPHVVPVIAEKL

SEQ ID NO: 924 - protein, 20 aa, Rana temporaria
VNPIILGVLPKFVCLITKKC

SEQ ID NO: 925 - protein, 17 aa, Rana temporaria
FITLLLRKFICSITKKC

SEQ ID NO: 926 - protein, 29 aa, Rana temporaria
GLWETIKNFGKKFTLNILHKLKCKIGGGC

SEQ ID NO: 927 - protein, 29 aa, Rana temporaria
GLWETIKNFGKKFTLNILHNLKCKIGGGC

SEQ ID NO: 928 - protein, 13 aa, Oncorhynchus mykiss
SGFVLKGYTKTSQ

SEQ ID NO: 929 - protein, 13 aa, Oncorhynchus mykiss
AGFVLKGYTKTSQ

SEQ ID NO: 930 - protein, 20 aa, Bombina variegata
IIGPVLGMVGSALGGLLKKI

SEQ ID NO: 931 - protein, 20 aa, Bombina variegata
LIGPVLGLVGSALGGLLKKI

SEQ ID NO: 932 - protein, 20 aa, Bombina variegata
IIGPVLGLVGSALGGLLKKI

SEQ ID NO: 933 - protein, 27 aa, Bombina variegata
GIGASILSAGKSALKGFAKGLAEHFAN

SEQ ID NO: 934 - protein, 35 aa, Mus musculus
LRDLVCYCRTRGCKRRERMNGTCRKGHLMYTLCCR

SEQ ID NO: 935 - protein, 30 aa, Macaca mulatta
ACYCRIPACLAGERRYGTCFYMGRVWAFCC

SEQ ID NO: 936 - protein, 13 aa, Litoria aurea
GLFDIIKKIAESI

SEQ ID NO: 937 - protein, 16 aa, Litoria aurea
GLLDIVKKVVGAFGSL

SEQ ID NO: 938 - protein, 16 aa, Litoria aurea
GLFDIVKKVVGALGSL

SEQ ID NO: 939 - protein, 16 aa, Litoria aurea
GLFDIVKKVVGAIGSL

SEQ ID NO: 940 - protein, 16 aa, Litoria aurea
GLFDIVKKVVGTIAGL

SEQ ID NO: 941 - protein, 16 aa, Litoria aurea
GLFDIVKKVVGAFGSL

SEQ ID NO: 942 - protein, 16 aa, Litoria aurea
GLFDIAKKVIGVIGSL

SEQ ID NO: 943 - protein, 17 aa, Litoria aurea
GLFDIVKKIAGHIAGSI

SEQ ID NO: 944 - protein, 17 aa, Litoria aurea
GLFDIVKKIAGHIASSI

SEQ ID NO: 945 - protein, 17 aa, Litoria aurea
GLFDIVKKIAGHIVSSI

SEQ ID NO: 946 - protein, 30 aa, Pachycondyla goeldii
GWKDWAKKAGGWLKKKGPGMAKAALKAAMQ

SEQ ID NO: 947 - protein, 30 aa, Pachycondyla goeldii
GWKDWLKKGKEWLKAKGPGIVKAALQAATQ

SEQ ID NO: 948 - protein, 30 aa, Pachycondyla goeldii
GWKDWLNKGKEWLKKKGPGIMKAALKAATQ

SEQ ID NO: 949 - protein, 29 aa, Pachycondyla goeldii
DFKDWMKTAGEWLKKKGPGILKAAMAAAT

SEQ ID NO: 950 - protein, 30 aa, Pachycondyla goeldii
GLKDWVKIAGGWLKKKGPGILKAAMAAATQ

SEQ ID NO: 951 - protein, 18 aa, Pachycondyla goeldii
GLVDVLGKVGGLIKKLLP

SEQ ID NO: 952 - protein, 19 aa, Pachycondyla goeldii
GLVDVLGKVGGLIKKLLPG

SEQ ID NO: 953 - protein, 24 aa, Pachycondyla goeldii
LLKELWTKMKGAGKAVLGKIKGLL

SEQ ID NO: 954 - protein, 24 aa, Pachycondyla goeldii
LLKELWTKIKGAGKAVLGKIKGLL

SEQ ID NO: 955 - protein, 25 aa, Pachycondyla goeldii
WLGSALKIGAKLLPSVVGLFKKKKQ

SEQ ID NO: 956 - protein, 25 aa, Pachycondyla goeldii
WLGSALKIGAKLLPSVVGLFQKKKK

SEQ ID NO: 957 - protein, 26 aa, Pachycondyla goeldii
GIWGTLAKIGIKAVPRVISMLKKKKQ

SEQ ID NO: 958 - protein, 26 aa, Pachycondyla goeldii
GIWGTALKWGVKLLPKLVGMAQTKKQ

SEQ ID NO: 959 - protein, 24 aa, Pachycondyla goeldii
FWGALIKGAAKLIPSVVGLFKKKQ

SEQ ID NO: 960 - protein, 20 aa, Pachycondyla goeldii
FIGTALGIASAIPAIVKLFK

SEQ ID NO: 961 - protein, 11 aa, Rana tigerina
FCTMIPIPRCY

SEQ ID NO: 962 - protein, 12 aa, Rana tigerina
RVCFAIPLPICH

SEQ ID NO: 963 - protein, 12 aa, Rana tigerina
RVCYAIPLPICY

SEQ ID NO: 964 - protein, 41 aa, Hadrurus aztecus
GILDTIKSIASKVWNSKTVQDLKRKGINWVANKLGVSPQAA

SEQ ID NO: 965 - protein, 33 aa, Rana temporaria
GLLSGLKKVGKHVAKNVAVSLMDSLKCKISGDC

SEQ ID NO: 966 - protein, 25 aa, Rana catesbeiana
SMLSVLKNLGKVGLGFVACKINKQC

SEQ ID NO: 967 - protein, 31 aa, Rana catesbeiana
GLFLDTLKGAAKDVAGKLEGLKCKITGCKLP

SEQ ID NO: 968 - protein, 32 aa, Rana catesbeiana
GFLDIINKLGKTFAGHMLDKIKCTIGTCPPSP

SEQ ID NO: 969 - protein, 24 aa, Rana catesbeiana
FLPFIARLAAKVFPSIICSVTKKC

SEQ ID NO: 970 - protein, 13 aa, Rana catesbeiana
FISAIASMLGKFL

SEQ ID NO: 971 - protein, 13 aa, Rana catesbeiana
FLSAIASMLGKFL

SEQ ID NO: 972 - protein, 13 aa, Rana catesbeiana
FISAIASFLGKFL

SEQ ID NO: 973 - protein, 14 aa, Rana catesbeiana
FLFPLITSFLSKVL

SEQ ID NO: 974 - protein, 24 aa, Rana luteiventris
FLPMLAGLAASMVPKLVCLITKKC

SEQ ID NO: 975 - protein, 24 aa, Rana luteiventris
FLPMLAGLAASMVPKFVCLITKKC

SEQ ID NO: 976 - protein, 32 aa, Rana luteiventris
GILDSFKGVAKGVAKDLAGKLLDKLKCKITGC

SEQ ID NO: 977 - protein, 32 aa, Rana luteiventris
GILSSIKGVAKGVAKNVAAQLLDTLKCKITGC

SEQ ID NO: 978 - protein, 13 aa, Rana luteiventris
VLPLISMALGKLL

SEQ ID NO: 979 - protein, 14 aa, Rana luteiventris
NFLGTLINLAKKIM

SEQ ID NO: 980 - protein, 14 aa, Rana luteiventris
FLPILINLIHKGLL

SEQ ID NO: 981 - protein, 24 aa, Rana berlandieri
FLPFIAGMAAKFLPKIFCAISKKC

SEQ ID NO: 982 - protein, 24 aa, Rana berlandieri
FLPAIAGMAAKFLPKIFCAISKKC

SEQ ID NO: 983 - protein, 24 aa, Rana berlandieri
FLPFIAGVAAKFLPKIFCAISKKC

SEQ ID NO: 984 - protein, 24 aa, Rana berlandieri
FLPAIAGVAAKFLPKIFCAISKKC

SEQ ID NO: 985 - protein, 24 aa, Rana berlandieri
FLPAIVGAAAKFLPKIFCVISKKC

SEQ ID NO: 986 - protein, 24 aa, Rana berlandieri
FLPFIAGMAANFLPKIFCAISKKC

SEQ ID NO: 987 - protein, 28 aa, Rana berlandieri
GLLDTIKGVAKTVAASMLDKLKCKISGC

SEQ ID NO: 988 - protein, 24 aa, Rana pipiens
FLPIIAGVAAKVFPKIFCAISKKC

SEQ ID NO: 989 - protein, 24 aa, Rana pipiens
FLPIIAGIAAKVFPKIFCAISKKC

SEQ ID NO: 990 - protein, 24 aa, Rana pipiens
FLPIIASVAAKVFSKIFCAISKKC

SEQ ID NO: 991 - protein, 24 aa, Rana pipiens
FLPIIASVAANVFSKIFCAISKKC

SEQ ID NO: 992 - protein, 24 aa, Rana pipiens
FLPIIASVAAKVFPKIFCAISKKC

SEQ ID NO: 993 - protein, 28 aa, Rana luteiventris
GLMDTVKNVAKNLAGHMLDKLKCKITGC

SEQ ID NO: 994 - protein, 13 aa, Rana luteiventris
FLPIVGKLLSGLL

SEQ ID NO: 995 - protein, 24 aa, Rana sylvatica
FLPVVAGLAAKVLPSIICAVTKKC

SEQ ID NO: 996 - protein, 25 aa, Rana clamitans
SMLSVLKNLGKVGLGLVACKINKQC

SEQ ID NO: 997 - protein, 20 aa, Rana clamitans
FLGGLMKAFPALICAVTKKC

SEQ ID NO: 998 - protein, 20 aa, Rana clamitans
FLGGLMKAFPAIICAVTKKC

SEQ ID NO: 999 - protein, 31 aa, Rana clamitans
GLFLDTLKGAAKDVAGKLLEGLKCKIAGCKP

SEQ ID NO: 1000 - protein, 27 aa, Rana clamitans
GLFLDTLKGLAGKLLQGLKCIKAGCKP

SEQ ID NO: 1001 - protein, 13 aa, Rana clamitans
FLPFLAKILTGVL

SEQ ID NO: 1002 - protein, 13 aa, Rana clamitans
FLPLFASLIGKLL

SEQ ID NO: 1003 - protein, 13 aa, Rana clamitans
FLPFLASLLTKVL

SEQ ID NO: 1004 - protein, 13 aa, Rana clamitans
FLPFLASLLSKVL

SEQ ID NO: 1005 - protein, 13 aa, Rana clamitans
FLPFLATLLSKVL

SEQ ID NO: 1006 - protein, 24 aa, Rana sphenocephala
FLPAIVGAAGQFLPKIFCAISKKC

SEQ ID NO: 1007 - protein, 24 aa, Rana sphenocephala
FLPAIVGAAGKFLPKIFCAISKKC

SEQ ID NO: 1008 - protein, 24 aa, Rana sphenocephala
FFPIVAGVAGQVLKKIYCTISKKC

SEQ ID NO: 1009 - protein, 12 aa, Bacillus licheniformis
ISLEICAIFHDN

SEQ ID NO: 1010 - protein, 21 aa, Morone chrysops x Morone saxatilis
GCRFCCNCCPNMSGCGVCCRF

SEQ ID NO: 1011 - protein, 27 aa, Bombina maxima
GIGTKILGGVKTALKGALKELASTYAN

SEQ ID NO: 1012 - protein, 27 aa, Bombina maxima
GIGTKILGGVKTALKGALKELASTYVN

SEQ ID NO: 1013 - protein, 27 aa, Bombina maxima
GIGGKILSGLKTALKGAAKELASTYLH

SEQ ID NO: 1014 - protein, 27 aa, Bombina maxima
GIGGVLLSAGKAALKGLAKVLAEKYAN

SEQ ID NO: 1015 - protein, 27 aa, Bombina maxima
SIGAKILGGVKTFFKGALKELASTYLQ

SEQ ID NO: 1016 - protein, 20 aa, Bombina maxima
ILGPVISTIGGVLGGLLKNL

SEQ ID NO: 1017 - protein, 20 aa, Bombina maxima
ILGPVLGLVGNALGGLIKNE

SEQ ID NO: 1018 - protein, 20 aa, Bombina maxima
ILGPVLSLVGNALGGLLKNE

SEQ ID NO: 1019 - protein, 40 aa, Ginkgo biloba
ANTAFVSSAHNTQKIPAGAPFNRNLRAMLADLRQNAAFAG

SEQ ID NO: 1020 - protein, 24 aa, Pseudis paradoxa
GLNTLKKVFQGLHEAIKLINNHVQ

SEQ ID NO: 1021 - protein, 24 aa, Pseudis paradoxa
GLNALKKVFQGIHEAIKLINNHVQ

SEQ ID NO: 1022 - protein, 23 aa, Pseudis paradoxa
GINTLKKVIQGLHEVIKLVSNHE

SEQ ID NO: 1023 - protein, 23 aa, Pseudis paradoxa
GINTLKKVIQGLHEVIKLVSNHA

SEQ ID NO: 1024 - protein, 15 aa, Oncorhynchus mykiss
SKGKKANKDVELARG

SEQ ID NO: 1025 - protein, 14 aa, Rana japonica
FFPIGVFCKIFKTC

SEQ ID NO: 1026 - protein, 21 aa, Rana japonica
FGLPMLSILPKALCILLKRKC

SEQ ID NO: 1027 - protein, 45 aa, Parabuthus schlechteri
FKLGSFLKKAWKSKLAKKLRAKGKEMLKDYAKGLLEGGSEEVPGQ

SEQ ID NO: 1028 - protein, 44 aa, Opistophthalmus carinatus
GKVWDWIKSTAKKLWNSEPVKELKNTALNAAKNLVAEKIGATPS

SEQ ID NO: 1029 - protein, 44 aa, Opistophthalmus carinatus
GKVWDWIKSTAKKLWNSEPVKELKNTALNAAKNFVAEKIGATPS

SEQ ID NO: 1030 - protein, 12 aa, Oncorhynchus mykiss
AERVGAGAPVYL

SEQ ID NO: 1031 - protein, 13 aa, Oncorhynchus mykiss
PKRKSATKGDEPA

SEQ ID NO: 1032 - protein, 17 aa, Oncorhynchus mykiss
KAVAAKKSPKKAKKPAT

SEQ ID NO: 1033 - protein, 9 aa, Serratia plymuthica
DYHHGVRVL

SEQ ID NO: 1034 - protein, 33 aa, Dolabella auricularia
SHQDCYEALHKCMASHSKPFSCSMKFHMCLQQQ

SEQ ID NO: 1035 - protein, 22 aa, Serratia plymuthica
ALPKKLKYLNLFNDGFNYMGVV

SEQ ID NO: 1036 - protein, 39 aa, Glossina morsitans
GWLKKIGKKIERVGQNTRDATVKGLEVAQQAANVAATVR

SEQ ID NO: 1037 - protein, 35 aa, Heliothis virescens
RWKVFKKIEKVGRNIRDGVIKAAPAIEVLGQAKAL

SEQ ID NO: 1038 - protein, 41 aa, Heliothis virescens
GKIPIGAIKKAGKAIGKGLRAVNIASTAHDVYTFFKPKKRH

SEQ ID NO: 1039 - protein, 22 aa, Heliothis virescens
QRFIHPTYRPPPQPRRPVIMRA

SEQ ID NO: 1040 - protein, 55 aa, Locusta migratoria
ATTGCSCPQCIIFDPICASSYKNGRRGFSSGCHMRCYNRCHGTDYFQISKGSKCI

SEQ ID NO: 1041 - protein, 25 aa, Chrysophrys major
FFGWLIKGAIHAGKAIHGLIHRRRH

SEQ ID NO: 1042 - protein, 25 aa, Chrysophrys major
FFGWLIRGAIHAGKAIHGLIHRRRH

SEQ ID NO: 1043 - protein, 20 aa, Chrysophrys major
FIGLLISAGKAIHDLIRRRH

SEQ ID NO: 1044 - protein, 18 aa, Bacillus thuringiensis
DWTAWSALVAAACSVELL

SEQ ID NO: 1045 - protein, 10 aa, Vigna sesquipedalis
KTCENLADTY

SEQ ID NO: 1046 - protein, 39 aa, Ceratitis capitata
GWLKKIGKKIERVGQHTRDATIQTIAVAQQAANVAATAR

SEQ ID NO: 1047 - protein, 39 aa, Ceratitis capitata
GWLKKIGKKIERVGQHTRDATIQTIGVAQQAANVAATLK

SEQ ID NO: 1048 - protein, 32 aa, Ceratitis capitata
SLGGVISGAKKVAKVAIPIGKAVLPVVAKLVG

SEQ ID NO: 1049 - protein, 26 aa, Drosophila melanogaster
HRHQGPIFDTRPSPFNPNQPRPGPIY

SEQ ID NO: 1050 - protein, 43 aa, Tenebrio molitor
VTCDILSVEAKGVKLNDAACAAHCLFRGRSGGYCNGKRVCVCR

SEQ ID NO: 1051 - protein, 45 aa, Bos taurus
GFTQGVRNSQSCRRNKGICVPIRCPGSMRQIGTCLGAQVKCCRRK

SEQ ID NO: 1052 - protein, 29 aa, Rattus norvegicus
CSCRTSSCRFGERLSGACRLNGRIYRLCC

SEQ ID NO: 1053 - protein, 31 aa, Rattus norvegicus
ACYCRIGACVSGERLTGACGLNGRIYRLCCR

SEQ ID NO: 1054 - protein, 32 aa, Rattus norvegicus
VTCYCRSTRCGFRERLSGACGYRGRIYRLCCR

SEQ ID NO: 1055 - protein, 32 aa, Rattus norvegicus
VTCYCRRTRCGFRERLSGACGYRGRIYRLCCR

SEQ ID NO: 1056 - protein, 31 aa, Cavia porcellus
RRCICTTRTCRFPYRRLGTCIFQNRVYTFCC

SEQ ID NO: 1057 - protein, 23 aa, Kasina senegalensis
CYSAAKYPGFQEFINRKYKSSRF

SEQ ID NO: 1058 - protein, 47 aa, Litopenaeus vannamei
HSSGYTRPLPKPSRPIFIRPIGCDVCYGIPSSTARLCCFRYGDCCHR

SEQ ID NO: 1059 - protein, 55 aa, Litopenaeus setiferus
QGYKGPYTRPILRPYVRPVVSYNACTLSCRGITTTQARSCSTRLGRCCHVAKGYS

SEQ ID NO: 1060 - protein, 55 aa, Litopenaeus setiferus
QGCKGPYTRPILRPYVRPVVSYNACTLSCRGITTTQARSCCTRLGRCCHVAKGYS

SEQ ID NO: 1061 - protein, 47 aa, Litopenaeus setiferus
YSSGYTRPLPKPSRPIFIRPIGCDVCYGIPSSTARLCCFRYGDCCHR

SEQ ID NO: 1062 - protein, 21 aa, Xenopus laevis
GMASKAGAIAGKIAKVALKAL

SEQ ID NO: 1063 - protein, 27 aa, Bombina orientalis
GIGGALLSAGKSALKGLAKGLAEHFAN

SEQ ID NO: 1064 - protein, 32 aa, Phyllomedusa bicolor
SLGSFLKGVGTTLASVGKVVSDQFGKLLQAGQ

SEQ ID NO: 1065 - protein, 35 aa, Aedes albopictus
GGLKKLGKKLEGVGKRVFKASEKALPVLTGYKAIG

SEQ ID NO: 1066 - protein, 49 aa, Clitoria ternatea
NLCERASLTWTGNCGNTGHCDTQCRNWESAKHGACHKRGNWKCFCYFDC

SEQ ID NO: 1067 - protein, 6 aa, Bos taurus
RRWQWR

SEQ ID NO: 1068 - protein, 32 aa, Bacillus subtilis
WKSESVCTPGCVTGVLQTCFLQTITCNCHISK

SEQ ID NO: 1069 - protein, 11 aa, Rana tigerina
RVCYAIPLPIC

SEQ ID NO: 1070 - protein, 27 aa, Homo sapiens
KSKEKIGKEFKRIVQRIKDFLRNLVPR

SEQ ID NO: 1071 - protein, 18 aa, Apis mellifera
GNNRPIYIPQPRPPHPRL

SEQ ID NO: 1072 - protein, 27 aa, Xenopus tropicalis
GFLGPLLKLAAKGVAKVIPHLIPSRQQ

SEQ ID NO: 1073 - protein, 25 aa, Xenopus tropicalis
GCWSTVLGGLKKFAKGGLEAIVNPK

SEQ ID NO: 1074 - protein, 22 aa, Xenopus tropicalis
GVFLDALKKFAKGGMNAVLNPK

SEQ ID NO: 1075 - protein, 18 aa, Xenopus tropicalis
GLLGPLLKIAAKVGSNLL

SEQ ID NO: 1076 - protein, 28 aa, Human immunodeficiency virus I
RVIEVVQGACRAIRHIPRRIRQGLERIL

SEQ ID NO: 1077 - protein, 29 aa, Equine infectious anemia virus
RIAGYGLRGLAVIIRICIRGLNLIFEIIR

SEQ ID NO: 1078 - protein, 10 aa, Anoplius samariensis
GLLKRIKTLL

SEQ ID NO: 1079 - protein, 22 aa, Morone chrysops x Morone saxatilis
FIHHIFRGIVHAGRSIGRFLTG

SEQ ID NO: 1080 - protein, 31 aa, Artificial Sequence
  synthetic human lactoferrin positions 171-201
FFSASCVPGADKGQFPNLCRLCAGTGENKCA

SEQ ID NO: 1081 - protein, 47 aa, Artificial Sequence
  synthetic Pyrularia pubera (oil nut) thionin mutation
KSCCRNTWARNCYNVCRLPGTISREICAKKCRCKIISGTTCPSDYPK

SEQ ID NO: 1082 - protein, 42 aa, Stomoxys calcitrans; identical to SEQ ID NO: 625

SEQ ID NO: 1083 - protein, 35 aa, Cupiennius salei
GFGSLFKFLAKKVAKTVAKQAAKQGAKYIANKQME

SEQ ID NO: 1084 - protein, 35 aa, Cupiennius salei
GFGSLFKFLAKKVAKTVAKQAAKQGAKYIANKQTE

SEQ ID NO: 1085 - protein, 35 aa, Cupiennius salei
GFGSLFKFLAKKVAKTVAKQAAKQGAKYVANKHME

SEQ ID NO: 1086 - protein, 51 aa, Hippoglossus hippoglossus
SGRGKTGGKARAKAKTRSSRAGLQFPVGRVHRLLRKGNYAHRVGAGAPVYL

SEQ ID NO: 1087 - protein, 43 aa, Carnobacterium piscicola; identical to SEQ ID NO: 752

SEQ ID NO: 1088 - protein, 19 aa, Artificial Sequence
  synthetic Helicobacter pylori ribosomal protein L1 (rpl1) positions 2-20, hypothetical protein, HP 2-20
AKKVFKRLEKLFSKIQNDK

SEQ ID NO: 1089 - protein, 20 aa, Bombina maxima
ILGPVLGLVSDTLDDVLGIL

SEQ ID NO: 1090 - protein, 34 aa, Rattus norvegicus
GLVRKGGEKFGEKLRKIGQKIKEFFQKLALEIEQ

SEQ ID NO: 1091 - protein, 18 aa, Artificial Sequence
  synthetic alpha-helical antibiotic peptide S9-P18 analog
KWKLFKKISKFLHLAKKF

SEQ ID NO: 1092 - protein, 18 aa, Artificial Sequence
  synthetic alpha-helical antibiotic peptide L9-P18 analog
KWKLFKKILKFLHLAKKF

SEQ ID NO: 1093 - protein, 23 aa, Styela clava
FLRFIGSVIHGIGHLVHHIGVAL

SEQ ID NO: 1094 - protein, 12 aa, Homo sapiens
AKRHHGYKRKFH

SEQ ID NO: 1095 - protein, 20 aa, Homo sapiens
LAHQKPFIRKSYKCLHKRCR

SEQ ID NO: 1096 - protein, 21 aa, Rana nigromaculata
GLLSKVLGVGKKVLCGVSGLC

SEQ ID NO: 1097 - protein, 33 aa, Rana nigromaculata
GLLDSIKGMAISAGKGALQNLLKVASCKLDKTC

SEQ ID NO: 1098 - protein, 15 aa, Homo sapiens
VAIALKAAHYHTHKE

SEQ ID NO: 1099 - protein, 30 aa, Halocynthia aurantium
ILQKAVLDCLKAAGSSLSKAAITAIYNKIT

SEQ ID NO: 1100 - protein, 18 aa, Artificial Sequence
  synthetic linear amphipathic beta-sheet cationic antimicrobial peptide KIGAKI repeat
KIGAKIKIGAKIKIGAKI

SEQ ID NO: 1101 - protein, 25 aa, Lycosa cardinensis
IWLTALKFLGKHAAKHLAKQQLSKL

SEQ ID NO: 1102 - protein, 27 aa, Lycosa cardinensis
KIKWFKTMKSIAKFIAKEQMKKHLGGE

SEQ ID NO: 1103 - protein, 20 aa, Impatiens balsamina
QYRHRCCAWGPGRKYCKRWC

SEQ ID NO: 1104 - protein, 20 aa, Impatiens balsamina
EWGRRCCGWGPGRRYCRRWC

SEQ ID NO: 1105 - protein, 14 aa, Artificial Sequence
  synthetic histatin 5 derivative Dhvar4
KRLFKKLLFSLRKY

SEQ ID NO: 1106 - protein, 14 aa, Artificial Sequence
  synthetic histatin 5 derivative Dhvar5
LLLFLLKKRKKRKY

SEQ ID NO: 1107 - protein, 20 aa, Bombina maxima
ILGPVLSMVGSALGGLIKKI

SEQ ID NO: 1108 - protein, 20 aa, Homo sapiens
ILGPVLGLVGNALGGLIKKI

SEQ ID NO: 1109 - protein, 20 aa, Bombina maxima
ILGPVISKIGGVLGGLLKNL

SEQ ID NO: 1110 - protein, 6 aa, Ovis aries
DDDDDD

SEQ ID NO: 1111 - protein, 29 aa, Bacillus subtilis
VLSKSLCTPGCITGPLQTCYLCFPTFAKC

SEQ ID NO: 1112 - protein, 28 aa, Rana kenojei
GKQYFPKVGGRLSGKAPLAAKTHRRLKP

SEQ ID NO: 1113 - protein, 20 aa, Phaseolus lunatus
KTCENLADTFRGPCFATSNC

SEQ ID NO: 1114 - protein, 25 aa, Leptodactylus fallax
GVVDILKGAAKDIAGHLASKVMNKL

SEQ ID NO: 1115 - protein, 20 aa, Tulipa gesneriana
KSCCRNTTARNCYNVCRIPG

SEQ ID NO: 1116 - protein, 56 aa, Myrmecia pilosula
GLGSVFGRLARILGRVIPKVAKKLGPKVAKVLPKVMKEAIPMAVEMAKSQEEQQPQ

SEQ ID NO: 1117 - protein, 88 aa, Acaloepta luxuriosa
SVRTQDNAVNRQIFGSNGPYRDFQLSDCYLPLETNPYCNEWQFAYHWNNALMDCERAIYHGCNRTRNNFITLTACKNQAGPICNRRRH

SEQ ID NO: 1118 - protein, 30 aa, Salmo salar
AEVAPAPAAAAPAKAPKKKAAAKPKKAGPS

SEQ ID NO: 1119 - protein, 18 aa, Halocynthia aurantium
WLNALLHHGLNCAKGVLA

SEQ ID NO: 1120 - protein, 38 aa, Crassostrea virginica
GFGCPWNRYQCHSHCRSIGRLGGYCAGSLRLTCTCYRS

SEQ ID NO: 1121 - protein, 25 aa, Leptodactylus pentadactylus
GLLDTLKGAAKNVVGSLASKVMEKL

SEQ ID NO: 1122 - protein, 14 aa, Polybia paulista
IDWKKLLDAAKQIL

SEQ ID NO: 1123 - protein, 12 aa, Polybia paulista
ILGTILGLLKSL

SEQ ID NO: 1124 - protein, 25 aa, Leptodactylus ocellatus
GVVDILKGAGKDLLAHLVGKISEKV

SEQ ID NO: 1125 - protein, 22 aa, Leptodactylus ocellatus
GVLDIFKDAAKQILAHAAEKQI

SEQ ID NO: 1126 - protein, 21 aa, Leptodactylus ocellatus
GVLDILKNAAKNILAHAAEQI

SEQ ID NO: 1127 - protein, 27 aa, Gallus gallus
RFGRFLRKIRRFRPKVTITIQGSARFG

SEQ ID NO: 1128 - protein, 46 aa, Tulipa gesneriana
KSCCRNTVARNCYNVCRIPGTPRPVCAATCDCKLITGTKCPPGYEK

SEQ ID NO: 1129 - protein, 6 aa, Artificial Sequence
  synthetic antimicrobial peptide Combi-2
FRWWHR

SEQ ID NO: 1130 - protein, 27 aa, Bombina maxima
GIGRKFLGGVKTTFRCGVKDFASKHLY

SEQ ID NO: 1131 - protein, 42 aa, Spodoptera litura
GKIPVKAIKKAGAAIGKGLRAINIASTAHDVYSFFKPKHKKK

SEQ ID NO: 1132 - protein, 19 aa, Parasilurus asotus
KGRGKQGGKVRAKAKTRSS

SEQ ID NO: 1133 - protein, 21 aa, Kassina senegalensis
GFMKYIGPLIPHAVKAISDLI

SEQ ID NO: 1134 - protein, 26 aa, Gallus gallus
RVKRVWPLVIRTVIAGYNLYRAIKKK

SEQ ID NO: 1135 - protein, 25 aa, Pleurotus eryngii
ATRVVYCNRRSGSVVGGDDTVYYEG

SEQ ID NO: 1136 - protein, 35 aa, Dendrocalamus latiflorus
TTLTLHNLCPYPVWWLVTPNNGGFPIIDNTPVVLG

SEQ ID NO: 1137 - protein, 10 aa, Cocos nucifera
EQCREEEDDR

SEQ ID NO: 1138 - protein, 44 aa, Pandinus imperator
GKVWDWIKSAAKKIWSSEPVSQLKGQVLNAAKNYVAEKIGATPT

SEQ ID NO: 1139 - protein, 47 aa, Phaseolus vulgaris
KTCENLADTFRGPCFATSNCDDHCKNKEHLLSGRCRDDFRCWCTRNC

SEQ ID NO: 1140 - protein, 17 aa, Rana dybowskii
FLIGMTHGLICLISRKC

SEQ ID NO: 1141 - protein, 17 aa, Rana dybowskii
FLIGMTQGLICLITRKC

SEQ ID NO: 1142 - protein, 33 aa, Rana dybowskii
GLFDVVKGVLKGVGKNVAGSLLEQLKCKLSGGC

SEQ ID NO: 1143 - protein, 15 aa, Rana dybowskii
VWPLGLVICKALKIC

SEQ ID NO: 1144 - protein, 38 aa, Rana dybowskii
GLFSVVTGVLKAVGKNVAKNVGGSLLEQLKCKKISGGC

SEQ ID NO: 1145 - protein, 20 aa, Rana dybowskii
FLPLLLAGLPLKLCFLFKKC

SEQ ID NO: 1146 - protein, 26 aa, Rana pleuraden
SIITMTKEAKLPQLWKQIACRLYNTC

SEQ ID NO: 1147 - protein, 26 aa, Rana pleuraden
SIITMTKEAKLPQSWKQIACRLYNTC

SEQ ID NO: 1148 - protein, 46 aa, Rana grahami
GLFSKFAGKGIKNLIFKGVKHIGKEVGMDVIRTGIDVAGCKIKGEC

SEQ ID NO: 1149 - protein, 33 aa, Rana grahami
GLLDTFKNLALNAAKSAGVSVLNSLSCKLSKTC

SEQ ID NO: 1150 - protein, 33 aa, Rana grahami
GVLGTVKNLLIGAGKSAAQSVLKTLSCKLSNDC

SEQ ID NO: 1151 - protein, 37 aa, Rana grahami
GLFTLIKGAAKLIGKTVAKEAGKTGLELMACKITNQC

SEQ ID NO: 1152 - protein, 24 aa, Rana grahami
FLPLLAGLAANFLPKIFCKITKKC

SEQ ID NO: 1153 - protein, 21 aa, Rana grahami
GLLSGILGAGKHIVCGLSGLC

SEQ ID NO: 1154 - protein, 21 aa, Rana grahami
GLFGKILGVGKKVLCGLSGMC

SEQ ID NO: 1155 - protein, 21 aa, Rana grahami
GLLSGILGAGKNIVCGLSGLC

SEQ ID NO: 1156 - protein, 34 aa, Hylarana guentheri
GFSSLFKAGAKYLLKSVGKAGAQQLACKAANNCA

SEQ ID NO: 1157 - protein, 30 aa, Hylarana guentheri
GVITDALKGAAKTVAAELLRKAHCKLTNSC

SEQ ID NO: 1158 - protein, 26 aa, Hylarana guentheri
VIDDLKKVAKKVRRELLCKKHHKKLN

SEQ ID NO: 1159 - protein, 31 aa, Hylarana guentheri
SIWEGIKNAGKGFLVSILDKVRCKVAGGCNP

SEQ ID NO: 1160 - protein, 13 aa, Hylarana guentheri
FLPLLFGAISHLL

SEQ ID NO: 1161 - protein, 33 aa, Hylarana guentheri
GIMSLFKGVLKTAGKHVAGSLVDQLKCKITGGC

SEQ ID NO: 1162 - protein, 22 aa, Hylarana guentheri
FLGSIVGALASALPSLISKIRN

SEQ ID NO: 1163 - protein, 13 aa, Hylarana guentheri
FLGALAKIISGIF

SEQ ID NO: 1164 - protein, 24 aa, Rana cascadae
FLPILAGLAAKIVPKLFCLATKKC

SEQ ID NO: 1165 - protein, 13 aa, Rana cascadae
FLPIVGKLLSGLL

SEQ ID NO: 1166 - protein, 13 aa, Rana cascadae
FLPIIGKLLSGLL

SEQ ID NO: 1167 - protein, 13 aa, Rana cascadae
FLPLVTGLLSGLL

SEQ ID NO: 1168 - protein, 14 aa, Rana cascadae
NFLGTLVNLAKKIL

SEQ ID NO: 1169 - protein, 13 aa, Rana septentrionalis
FLSAITSLLGKLL

SEQ ID NO: 1170 - protein, 21 aa, Rana septentrionalis
GIWDTIKSMGKVFAGKILQNL

SEQ ID NO: 1171 - protein, 23 aa, Rana grahami
GLLRASSVWGRKYYVDLAGCAKA

SEQ ID NO: 1172 - protein, 20 aa, Rana dybowskii
FLSLALAALPKFLCLVFKKC

SEQ ID NO: 1173 - protein, 20 aa, Rana dybowskii
FLSLALAALPKLFCLIFKKC

SEQ ID NO: 1174 - protein, 20 aa, Rana dybowskii
FLPLLLAGLPKLLCLFFKKC

SEQ ID NO: 1175 - protein, 33 aa, Rana dybowskii
GLFDVVKGVLKGAGKNVAGSLLEQLKCKLSGGC

SEQ ID NO: 1176 - protein, 33 aa, Rana dybowskii; identical to SEQ ID NO: 1142

SEQ ID NO: 1177 - protein, 33 aa, Rana dybowskii
GIFDVVKGVLKGVGKNVAGSLLEQLKCKLSGGC

SEQ ID NO: 1178 - protein, 37 aa, Rana dybowskii
GLFSVVTGVLKAVGKNVAKNVGGSLLEQLKCKISGGC

SEQ ID NO: 1179 - protein, 14 aa, Rana dybowskii
FIGPIISALASLFG

SEQ ID NO: 1180 - protein, 28 aa, Rana palustris
ALFSILRGLKKLGNMGQAFVNCKIYKKC

SEQ ID NO: 1181 - protein, 27 aa, Rana palustris
ALSILRGLEKLAKMGIALTNCKATKKC

SEQ ID NO: 1182 - protein, 27 aa, Rana palustris
ALSILKGLEKLAKMGIALTNCKATKKC

SEQ ID NO: 1183 - protein, 31 aa, Rana palustris
GFFSTVKNLATNVAGTVIDTLKCKVTGGCRS

SEQ ID NO: 1184 - protein, 31 aa, Rana palustris
GFLSTVKNLATNVAGTVIDTLKCKVTGGCRS

SEQ ID NO: 1185 - protein, 48 aa, Rana palustris
GIFPKIIGKGIKTGIVNGIKSLVKGVGMKVFKAGLNNIGNTGCNEDEC

SEQ ID NO: 1186 - protein, 48 aa, Rana palustris
GIFPKIIGKGIKTGIVNGIKSLVKGVGMKVFKAGLSNIGNTGCNEDEC

SEQ ID NO: 1187 - protein, 38 aa, Homo sapiens
ALLGDFFRKSKEKIGKEFKRIVQRIKDFLRNLVPRTES

SEQ ID NO: 1188 - protein, 20 aa, Homo sapiens
KRIVQRIKDFLRNLVPRTES

SEQ ID NO: 1189 - protein, 30 aa, Homo sapiens
KSKEKIGKEFKRIVQRIKDFLRNLVPRTES

SEQ ID NO: 1190 - protein, 31 aa, Homo sapiens
RKSKEKIGKEFKRIVQRIKDFLRNLVPRTES

SEQ ID NO: 1191 - protein, 23 aa, Homo sapiens
LLGDFFRKSKEKIGKEFKRIVQR

SEQ ID NO: 1192 - protein, 29 aa, Homo sapiens
LLGDFFRKSKEKIGKEFKRIVQRIKDFLR

SEQ ID NO: 1193 - protein, 25 aa, Entamoeba histolytica
GEILCNLCTGLINTLENLLTTKGAD

SEQ ID NO: 1194 - protein, 43 aa, Enterococcus mundtii
KYYGNGVSCNKKGCSVDWGKAIGIIGNNSAANLATGGAAGWSK

SEQ ID NO: 1195 - protein, 22 aa, Litoria citropa
GLIGSIGKALGGLLVDVLKPKL

SEQ ID NO: 1196 - protein, 26 aa, Litoria citropa
GLIGSIGKALGGLLVDVLKPKLQAAS

SEQ ID NO: 1197 - protein, 21 aa, Litoria eucnemis
GLLGLLGSVVSHVVPAIVGHF

SEQ ID NO: 1198 - protein, 33 aa, Pardachirus marmoratus
GFFALIPKIISSPLFKTLLSAVGSALSSSGEQE

SEQ ID NO: 1199 - protein, 33 aa, Pardachirus marmoratus
GFFALIPKIISSPIFKTLLSAVGSALSSSGGQE

SEQ ID NO: 1200 - protein, 33 aa, Pardachirus marmoratus
GFFAFIPKIISSPLFKTLLSAVGSALSSSGEQE

SEQ ID NO: 1201 - protein, 33 aa, Pardachirus marmoratus
GFFAFIPKIISSPLFKTLLSAVGSALSSSGDQE

SEQ ID NO: 1202 - protein, 24 aa, Rana palustris
FLPLIAGLAANFLPKIFCAITKKC

SEQ ID NO: 1203 - protein, 24 aa, Rana palustris
FLPVIAGVAAKFLPKIFCAITKKC

SEQ ID NO: 1204 - protein, 46 aa, Rana palustris
GLFPKINKKKAKTGVFNIIKTVGKEAGMDLIRTGIDTIGCKIKGEC

SEQ ID NO: 1205 - protein, 46 aa, Rana palustris
GIFTKINKKKAKTGVFNIIKTIGKEAGMDVIRAGIDTISCKIKGEC

SEQ ID NO: 1206 - protein, 37 aa, Rana palustris
GLFSILKGVGKIALKGLAKNMGKMGLDLVSCKISKEC

SEQ ID NO: 1207 - protein, 28 aa, Rana palustris
GIMDTVKNVAKNLAGQLLDKLKCKITAC

SEQ ID NO: 1208 - protein, 28 aa, Rana palustris
GIMDTVKNAAKDLAGQLLDKLKCRITGC

SEQ ID NO: 1209 - protein, 28 aa, Rana palustris
GLLDTIKNTAKNLAVGLLDKIKCKMTGC

SEQ ID NO: 1210 - protein, 28 aa, Rana palustris
GIMDSVKNVAKNIAGQLLDKLKCKITGC

SEQ ID NO: 1211 - protein, 28 aa, Rana palustris
GIMDSVKNAAKNLAGQLLDTIKCKITAC

SEQ ID NO: 1212 - protein, 27 aa, Rana palustris
GIMDTVKNAAKDLAGQLDKLKCRITGC

SEQ ID NO: 1213 - protein, 13 aa, Rana palustris
FLPLVGKILSGLI

SEQ ID NO: 1214 - protein, 12 aa, Rana catesbeiana
FLPIASLLGKYL

SEQ ID NO: 1215 - protein, 37 aa, Rana luteiventris
GILSLFTGGIKALGKTLFKMAGKAGAEHLACKATNQC

SEQ ID NO: 1216 - protein, 37 aa, Rana berlandieri
GLFSILRGAAKFASKGLGKDLTKLGVDLVACKISKQC

SEQ ID NO: 1217 - protein, 37 aa, Rana pipiens
GFSSIFRGVAKFASKGLGKDLARLGVNLVACKISKQC

SEQ ID NO: 1218 - protein, 13 aa, Rana esculenta
FLPAIAGILSQLF

SEQ ID NO: 1219 - protein, 13 aa, Rana esculenta
FLPLIAGLIGKLF

SEQ ID NO: 1220 - protein, 13 aa, Pseudophryne guntheri
EGGGPQWAVGHFM

SEQ ID NO: 1221 - protein, 11 aa, Pseudophryne guntheri
EPHPDEFVGLM

SEQ ID NO: 1222 - protein, 11 aa, Pseudophryne guntheri
EPNPDEFVGLM

SEQ ID NO: 1223 - protein, 11 aa, Pseudophryne guntheri
EPHPNEFVGLM

SEQ ID NO: 1224 - protein, 11 aa, Pseudophryne guntheri
EPNPDEFFGLM

SEQ ID NO: 1225 - protein, 24 aa, Pandinus imperator
FWGALAKGALKLIPSLFSSFSKKD

SEQ ID NO: 1226 - protein, 11 aa, Pseudophryne guntheri
EPNPNEFFGLM

SEQ ID NO: 1227 - protein, 32 aa, Bacillus subtilis; identical to SEQ ID NO: 1068

SEQ ID NO: 1228 - protein, 29 aa, Bacillus subtilis
VLSKSLCTPGCITGPLQTCYLCFPTFAKC

SEQ ID NO: 1229 - protein, 49 aa, Homo sapiens
FELDRICGYGTARCRKKCRSQEYRIGRCPNTYACCLRKWDESLLNRTKP

SEQ ID NO: 1230 - protein, 37 aa, Macaca mulatta
RLGNFFRKVKEKIGGGLKKVGQKIKDFLGNLVPRTAS

SEQ ID NO: 1231 - protein, 43 aa, Cavia porcellus
GLRKKFRKTRKRIQKLGRKIGKTGRKVWKAWREYGQIPYPCRI

SEQ ID NO: 1232 - protein, 38 aa, Canis lupus
RLKELITTGGQKIGEKIRRIGQRIKDFFKNLQPREEKS

SEQ ID NO: 1233 - protein, 37 aa, Rana versabilis
GLFSILKGVGKIAIKGLGKNLGKMGLDLVSCKISKEC

SEQ ID NO: 1234 - protein, 33 aa, Ovis aries
GLFGRLRDSLQRGGQKILEKAERIWCKIKDIFR

SEQ ID NO: 1235 - protein, 43 aa, Ovis aries
RFRPPIRRPPIRPPFRPPFRPPVRPPIRPPFRPPFRPPIGPFP

SEQ ID NO: 1236 - protein, 52 aa, Ovis aries
RRLRPRHQHFPSERPWPKPLPLPLPRPGPRPWPKPLPLPLPRPGLRPWPKPL

SEQ ID NO: 1237 - protein, 60 aa, Ovis aries
RRLRPRRPRLPRPRPRPRPRPRSLPLPRPQPRRIPRPILLPWRPPRPIPRPQIQPIPRWL

SEQ ID NO: 1238 - protein, 94 aa, Ovis aries
RRLRPRRPRLPRPRPRPRPRPRSLPLPRPKPRPIPRPLPLPRPRPKPIPRPLPLPRPRPRRIPRPLPLPRPRPRPIPRPLPLPQPQPSPIPRPL

SEQ ID NO: 1239 - protein, 28 aa, Rana versabilis
GIMDTVKGVAKTVAASLLDKLKCKITGC

SEQ ID NO: 1240 - protein, 26 aa, Equus caballus
KRFGRLAKSFLRMRILLPRRKILLAS

SEQ ID NO: 1241 - protein, 27 aa, Equus caballus
KRRHWFPLSFQEFLEQLRRFRDQLPFP

SEQ ID NO: 1242 - protein, 40 aa, Equus caballus
KRFHSVGSLIQRHQQMIRDKSEATRHGIRIITRPKLLLAS

SEQ ID NO: 1243 - protein, 79 aa, Sus scrofa
AFPPPNVPGPRFPPPNFPGPRFPPPNFPGPRFPPPNFPGPRFPPPNFPGPPFPPPIFPGPWFPPPPPFRPPPFGPPRFP

SEQ ID NO: 1244 - protein, 79 aa, Sus scrofa
AFPPPNVPGPRFPPPNVPGPRFPPPNFPGPRFPPPNFPGPRFPPPNFPGPPFPPPIFPGPWFPPPPPFRPPPFGPPRFP

SEQ ID NO: 1245 - protein, 37 aa, Myxine glutinosa
GFFKKAWRKVKHAGRRVLDTAKGVGRHYVNNWLNRYR

SEQ ID NO: 1246 - protein, 30 aa, Myxine glutinosa
GWFKKAWRKVKNAGRRVLKGVGIHYGVGLI

SEQ ID NO: 1247 - protein, 66 aa, Oncorhynchus mykiss
RICSRDKNCVSRPGVGSIIGRPGGGSLIGRPGGGSVIGRPGGGSPPGGGSFNDEFIRDHSDGNRFA

SEQ ID NO: 1248 - protein, 23 aa, Rana tagoi
AIGSILGALAKGLPTLISWIKNR

SEQ ID NO: 1249 - protein, 13 aa, Rana tagoi
FLPILGKLLSGIL

SEQ ID NO: 1250 - protein, 13 aa, Litoria dahlii
GLFDIIKNIVSTL

SEQ ID NO: 1251 - protein, 13 aa, Litoria dahlii
GLFDIIKNIFSGL

SEQ ID NO: 1252 - protein, 23 aa, Litoria dahlii
GLWQLIKDKIKDAATGFVTGIQS

SEQ ID NO: 1253 - protein, 23 aa, Litoria dahlii
GLWQFIKDKLKDAATGLVTGIQS

SEQ ID NO: 1254 - protein, 23 aa, Litoria dahlii
GLWQFIKDKFKDAATGLVTGIQS

SEQ ID NO: 1255 - protein, 20 aa, Litoria dahlii
GLLGSIGNAIGAFIANKLKP

SEQ ID NO: 1256 - protein, 21 aa, Litoria dahlii
GLLGSIGNAIGAFIANKLKPK

SEQ ID NO: 1257 - protein, 20 aa, Litoria dahlii
GLLASLGKVLGGYLAEKLKP

SEQ ID NO: 1258 - protein, 21 aa, Litoria dahlii
GLLGSIGKVLGGYLAEKLKPK

SEQ ID NO: 1259 - protein, 21 aa, Litoria dahlii
GLLASLGKVLGGYLAEKLKPK

SEQ ID NO: 1260 - protein, 21 aa, Litoria dahlii
GLLASLGKVFGGYLAEKLKPK

SEQ ID NO: 1261 - protein, 37 aa, Mytilus edulis
GFGCPNDYPCHRHCKSIPGRAGGYCGGAHRLRCTCYR

SEQ ID NO: 1262 - protein, 39 aa, Mytilus galloprovincialis
GFGCPNNYACHQHCKSIRGYCGGYCAGWFRLRCTCYRCG

SEQ ID NO: 1263 - protein, 37 aa, Leiurus quinquestriatus
GFGCPLNQGACHRHCRSIRRRGGYCAGFFKQTCCYRN

SEQ ID NO: 1264 - protein, 37 aa, Androctonus australis
GFGCPFNQGACHRHCRSIRRRGGYCAGLFKQTCTCYR

SEQ ID NO: 1265 - protein, 37 aa, Orinthodoros moubata
GYGCPFNQYQCHSHCSGIRGYKGGYCKGTFKQTCKCY

SEQ ID NO: 1266 - protein, 45 aa, Vigna angularis
RTCMKKEGWGKCLIDTTCAHSCKNRGYIGGNCKGMTRTCYCLVNC

SEQ ID NO: 1267 - protein, 24 aa, Cryptotympana dubia
GLLNGLALRLGKRALKKIIKRLCR

SEQ ID NO: 1268 - protein, 11 aa, Oreumenes decoratus
SLLSLLRKLIT

SEQ ID NO: 1269 - protein, 18 aa, Macaca mulatta
RCLCRRGVCRCLCRRGVC

SEQ ID NO: 1270 - protein, 18 aa, Macaca mulatta
RCICTRGFCRCICTRGFC

SEQ ID NO: 1271 - protein, 6 aa, Artificial Sequence
  synthetic antimicrobial hexapeptide Combi-1
RRWWRF

SEQ ID NO: 1272 - protein, 37 aa, Galleria mellonella
DIQIPGIKKPTHRDIIIPNWNPNVRTQPWQRFGGNKS

SEQ ID NO: 1273 - protein, 42 aa, Galleria mellonella
EADEPLWLYKGDNIERAPTTADHPILPSIIDDVKLDPNRRYA

SEQ ID NO: 1274 - protein, 42 aa, Galleria mellonella
EIRLPEPFRFPSPTVPKPIDIDPILPHPWSPRQTYPIIARRS

SEQ ID NO: 1275 - protein, 44 aa, Galleria mellonella
DKLIGSCVWGATNYTSDCNAECKRRGYKGGHCGSFWNVNCWCEE

SEQ ID NO: 1276 - protein, 51 aa, Galleria mellonella
VQETQKLAKTVGANLEETNKKLAPQIKSAYDDFVKQAQEVQKKLHEAASKQ

SEQ ID NO: 1277 - protein, 60 aa, Galleria mellonella
ETESTPDYLKNIQQQLEEYTKNFNTQVQNAFDSDKIKSEVNNFIESLGKILNTEKKEAPK

SEQ ID NO: 1278 - protein, 39 aa, Galleria mellonella
ENFFKEIERAGQRIRDAIISAAPAVETLAQAQKIIKGGD

SEQ ID NO: 1279 - protein, 24 aa, Phyllomedusa bicolor
ALWKDILKNAGKAALNEINQLVNQ

SEQ ID NO: 1280 - protein, 20 aa, Phyllomedusa oreades
FLSLIPHAINAVSTLVHHSG

SEQ ID NO: 1281 - protein, 19 aa, Phyllomedusa oreades
FLSLIPHAINAVSAIAKHS

SEQ ID NO: 1282 - protein, 17 aa, Phyllomedusa hypochondrialis
SLIPHAINAVSAIAKHF

SEQ ID NO: 1283 - protein, 19 aa, Phyllomedusa hypochondrialis
FLSLIPHAINAVSAIAKHF

SEQ ID NO: 1284 - protein, 25 aa, Phyllomedusa hypochondrialis
GLWSTIKNVGKEAAIAAGKAALGAL

SEQ ID NO: 1285 - protein, 24 aa, Phyllomedusa sauvagei
GLRSKIWLWVLLMIWQESNKFKKM

SEQ ID NO: 1286 - protein, 46 aa, Homo sapiens [sequence omitted]

SEQ ID NO: 1287 - protein, 58 aa, Lactobacillus gasseri
IYWIADQFGIHLATGTARKLLDAMASGASLGTAFAAILGVTLPAWALAAAGALGATAA

SEQ ID NO: 1288 - protein, 69 aa, Clostridium beijerinckii
VAGALGVQTAAATTIVNVILNAGTLVTVLGIIASIASGGAGTLMTIGWATFKATVQKLAKQSMARAIAY

SEQ ID NO: 1289 - protein, 82 aa, Clostridium tyrobutyricum
PNWTKIGKCAGSIAWAIGSGLFGGAKLIKIKKYIAELGGLQKAAKLLVGATTWEEKLHAGGYALINLAAELTGVAGIQANCF

SEQ ID NO: 1290 - protein, 25 aa, Litoria eucnemis
GLLGAMFKVASKVLPHVVPAITEHF

SEQ ID NO: 1291 - protein, 21 aa, Litoria eucnemis
GLLGLLGSVVSHVLPAITQHL

SEQ ID NO: 1292 - protein, 23 aa, Xenopus laevis
GIGKFLHSAGKFGKAFVGEIMKS

SEQ ID NO: 1293 - protein, 48 aa, Oxyopes kitabensis
FRGLAKLLKIGLKSFARVLKKVLPKAAKAGKALAKSMADENAIRQQNQ

SEQ ID NO: 1294 - protein, 37 aa, Oxyopes kitabensis
GKFSVFGKILRSIAKVFKGVGKVRKQFKTASDLDKNQ

SEQ ID NO: 1295 - protein, 37 aa, Oxyopes kitabensis
GKFSGFAKILKSIAKFFKGVGKVRKGFKEASDLDKNQ

SEQ ID NO: 1296 - protein, 37 aa, Oxyopes kitabensis
GKLSGISKVLRAIAKFFKGVGKARKQFKEASDLDKNQ

SEQ ID NO: 1297 - protein, 37 aa, Oxyopes kitabensis
GKFSVFSKILRSIAKVFKGVGKVRKGFKTASDLDKNQ

SEQ ID NO: 1298 - protein, 24 aa, Pseudopleuronectes americanus
GKGRWLERIGKAGGIIIGGALDHL

SEQ ID NO: 1299 - protein, 20 aa, Pseudopleuronectes americanus
WLRRIGKGVKIIGGAALDHL

SEQ ID NO: 1300 - protein, 26 aa, Pseudopleuronectes americanus
GRRKRKWLRRIGKGVKIIGGAALDHL

SEQ ID NO: 1301 - protein, 24 aa, Pseudopleuronectes americanus
FLGALIKGAIHGGRFIHGMIQNHH

SEQ ID NO: 1302 - protein, 25 aa, Pseudopleuronectes americanus
GWGSIFKHGRHAAKHIGHAAVNHYL

SEQ ID NO: 1303 - protein, 25 aa, Limanda ferruginea
RWGKWFKKATHVGKHVGKAALTAYL

SEQ ID NO: 1304 - protein, 19 aa, Pseudopleuronectes americanus
FFRLLFHGVHHVGKIKPRA

SEQ ID NO: 1305 - protein, 25 aa, Hippoglossoides platessoides
GWKSVFRKAKKVGKTVGGLALDHYL

SEQ ID NO: 1306 - protein, 25 aa, Hippoglossoides platessoides
GWKKWFNRAKKVGKTVGGLAVDHYL

SEQ ID NO: 1307 - protein, 23 aa, Hippoglossoides platessoides
GWRLLLKKAEVKTVGKLALKHYL

SEQ ID NO: 1308 - protein, 26 aa, Glyptocephalus cynoglossus
AGWGSIFKHIFKAGKFIHGAIQAHND

SEQ ID NO: 1309 - protein, 21 aa, Glyptocephalus cynoglossus
GFWGKLFKLGLHGIGLLHLHL

SEQ ID NO: 1310 - protein, 19 aa, Glyptocephalus cynoglossus
GWKKWLRKGAKHLGQAAIK

SEQ ID NO: 1311 - protein, 23 aa, Glyptocephalus cynoglossus
GWKKWLRKGAKHLGQAAIKGLAS

SEQ ID NO: 1312 - protein, 24 aa, Hipoglossus hippoglossus
FLGLLFHGVHHVGKWIHGLIHGHH

SEQ ID NO: 1313 - protein, 20 aa, Bombina variegata
IIGPVLGLVGSALGGLLKKI

SEQ ID NO: 1314 - protein, 20 aa, Bombina variegata
IIGPVLGMVGSALGGLLKKI

SEQ ID NO: 1315 - protein, 17 aa, Bombina orientalis
ILGPILGLVSNALGGLL

SEQ ID NO: 1316 - protein, 18 aa, Bombina orientalis
IIGPVLGLVGKPLESLLE

SEQ ID NO: 1317 - protein, 18 aa, Bombina orientalis
IIGPVLGLVGKPLESLLE

SEQ ID NO: 1318 - protein, 62 aa, Enterococcus sp.
NRWYCNSAAGGVGGAAGCVLAGYVGEAKENIAGEVRKGWGMAGGFTHNKACKSFPGSGWASG

SEQ ID NO: 1319 - protein, 20 aa, Sparus aurata
CRFCCRCCPRMRGCGLCCRF

SEQ ID NO: 1320 - protein, 22 aa, Oreochromis mossambicus
GIKCRFCCGCCTPGICGVCCRF

SEQ ID NO: 1321 - protein, 20 aa, Oreochromis mossambicus
QSHLSLCRWCCNCCRSNKGC

SEQ ID NO: 1322 - protein, 40 aa, Oreochromis mossambicus
MTPFWRGVSLRPIGASCRDDSECITRLCRKRRCSLSVAQE

SEQ ID NO: 1323 - protein, 29 aa, Bos taurus
FAEPLPSEEEGESYSKEPPEMEKRYGGFM

SEQ ID NO: 1324 - protein, 38 aa, Aptenodytes patagonicus
SFGLCRLRRGSCAHGRCRFPSIPIGRCSRFVQCCRRVW

SEQ ID NO: 1325 - protein, 37 aa, Pongo pygmaeus
LLGDFFRKAREKIGEEFKRIVQRIKDFLRNLVPRTES

SEQ ID NO: 1326 - protein, 37 aa, Hylobates moloch
SLGNFFRKARKKIGEEFKRIVQRIKDFLQHLIPRTEA

SEQ ID NO: 1327 - protein, 37 aa, Presbytis obscura
RLGNFFRKAKKKIGRGLKKIGQKIKDFLGNLVPRTES

SEQ ID NO: 1328 - protein, 37 aa, Callithrix jacchus
RLGDILQKAREKIEGGLKKLVQKIKDFFGKFAPRTES

SEQ ID NO: 1329 - protein, 23 aa, Phyllomedusa bicolor
GLVTSLIKGAGKLLGGLFGSVTG

SEQ ID NO: 1330 - protein, 23 aa, Artificial Sequence
  synthetic plasticin ANCKF, analog of ANC
GLVTGLLKTAGKLLGDLFGSLTG

SEQ ID NO: 1331 - protein, 23 aa, Artificial Sequence
  synthetic plasticin PD36KF, analog of PD36
GVVTDLLKTAGKLLGNLFGSLSG

SEQ ID NO: 1332 - protein, 23 aa, Artificial Sequence
  synthetic plasticin PD36K, analog of PD36
GVVTDLLKTAGKLLGNLVGSLSG

SEQ ID NO: 1333 - protein, 94 aa, Gallus gallus
PITYLDAILAAVRLLNQRISGPCILRLREAQPRPGWVGTLQRRREVSFLVEDGPCPPGVDCRSCEPGALQHCVGTVSIEQQPTAELRCRPLRPQ

SEQ ID NO: 1334 - protein, 67 aa, Gallus gallus
MRILYLLLSVLFVVLQGVAGQPYFSSPIHACRYQRGVCIPGPCRWPYYRVGSCGSGLKSCCVRNRWA

SEQ ID NO: 1335 - protein, 62 aa, Gallus gallus
MKILCFFIVLFVAVHGAVGFSRSPRYHMQCGYRGTFCTPGKCPYGNAYLGLCRPKYSCCRWL

SEQ ID NO: 1336 - protein, 66 aa, Gallus gallus
MQILPLLFAVLLLMLRAEPGLSLARGLPQDCERRGGFCSHKSCPPGIGRIGLCSKEDFCCRSRWYS

SEQ ID NO: 1337 - protein, 40 aa, Gallus gallus
MTPFWRGVSLRPVGASCRDNSECITMLCRKNRCFLRTASE

SEQ ID NO: 1338 - protein, 31 aa, Rana esculenta
GLGSILGKILNVAGKVGKTIGKVADAVGNKE

SEQ ID NO: 1339 - protein, 31 aa, Rana esculenta
GLGSFLKNAIKIAGKVGSTIGKVADAIGNKE

SEQ ID NO: 1340 - protein, 31 aa, Rana esculenta
GLGSFFKNAIKIAGKVGSTIGKVADAIGNKE

SEQ ID NO: 1341 - protein, 13 aa, Rana ornativentris
FLPLLASLFSRLL

SEQ ID NO: 1342 - protein, 13 aa, Rana ornativentris
FLPLIGKILGTIL

SEQ ID NO: 1343 - protein, 13 aa, Rana ornativentris
FLPLLASLFSRLF

SEQ ID NO: 1344 - protein, 13 aa, Rana ornativentris
FLPLLASLFSGLF

SEQ ID NO: 1345 - protein, 32 aa, Rana ornativentris
GLFNVFKGLKTAGKHVAGSLLNQLKCKVSGGC

SEQ ID NO: 1346 - protein, 33 aa, Rana ornativentris
GIFNVFKGALKTAGKHVAGSLLNQLKCKVSGEC

SEQ ID NO: 1347 - protein, 14 aa, Rana grylio
SILPTIVSFLSKFL

SEQ ID NO: 1348 - protein, 14 aa, Rana grylio
SILPTIVSFLTKFL

SEQ ID NO: 1349 - protein, 14 aa, Rana grylio
FILPLIASFLSKFL

SEQ ID NO: 1350 - protein, 25 aa, Rana grylio
SMISVLKNLGKVGLGFVACKVNKQC

SEQ ID NO: 1351 - protein, 20 aa, Rana grylio
FLGGLMKIIPAAFCAVTKKC

SEQ ID NO: 1352 - protein, 31 aa, Rana grylio
GLLLDTLKGAAKDIAGIALEKLKCKITGCKP

SEQ ID NO: 1353 - protein, 23 aa, Rana grahami
GLLSGILGAGKHIVCGLTGCAKA

SEQ ID NO: 1354 - protein, 20 aa, Bombina maxima
ILGPVISTIGGVLGGLLKNL

SEQ ID NO: 1355 - protein, 39 aa, Galleria mellonella
KVNANAIKKGGKAIGKGFKVISAASTAHDVYEHIKNRRH

SEQ ID NO: 1356 - protein, 43 aa, Galleria mellonella
GKIPVKAIKKGGQIIGKALRGINIASTAHDIISQFKPKKKKNH

SEQ ID NO: 1357 - protein, 38 aa, Galleria mellonella
KVPIGAIKKGGKIIKKGLGVIGAAGTAHEVYSHVKNRH

SEQ ID NO: 1358 - protein, 38 aa, Galleria mellonella
KVPIGAIKKGGKIIKKGLGVLGAAGTAHEVYNHVRNRQ

SEQ ID NO: 1359 - protein, 38 aa, Galleria mellonella
KVPIGAIKKGGKIIKKGLGVIGAAGTAHEVYSHVKNRQ

SEQ ID NO: 1360 - protein, 38 aa, Galleria mellonella
KVPVGAIKKGGKAIKTGLGVVGAAGTAHEVYSHIRNRH

SEQ ID NO: 1361 - protein, 38 aa, Galleria mellonella
KGIGSALKKGGKIIKGGLGALGAIGTGQQVYEHVQNRQ

SEQ ID NO: 1362 - protein, 47 aa, Enterococcus faecium
TTHSGKYYGNGVYCTKNKCTVDWAKATTCIAGMSIGGFLGGAIPGKC

SEQ ID NO: 1363 - protein, 43 aa, Carnobacterium divergens
TKYYGNGVYCNSKKCWVDWGQASGCIGQTVVGGWLGGAIPGKC

SEQ ID NO: 1364 - protein, 43 aa, Carnobacterium divergens
TKYYGNGVYCNSKKCWVDWGTAQGCIDVVIGQLGGGIPGKGKC

SEQ ID NO: 1365 - protein, 44 aa, Bacillus coagulans
KYYGNGVTCGKHSCSVDWGKATTCIINNGAMAWATGGHQGTHKC

SEQ ID NO: 1366 - protein, 43 aa, Listeria innocua
KSYGNGVHCNKKKCWVDWGSAISTIGNNSAANWATGGAAGWKS

SEQ ID NO: 1367 - protein, 43 aa, Enterococcus mundtii
KYYGNGVSCNKKGCSVDWGKAIGIIGNNSAANLATGGAAGWKS

SEQ ID NO: 1368 - protein, 43 aa, Lactobacillus sakei
KYYGNGLSCNKSGCSVDWSKAISIIGNNAVANLTTGGAAGWKS

SEQ ID NO: 1369 - protein, 43 aa, Lactococcus lactis
KNYGNGVHCTKKGCSVDWGYAWANIANNSVMNGLTGGNAGWHN

SEQ ID NO: 1370 - protein, 37 aa, Lactococcus lactis
TSYGNGVHCNKSKCWIDVSELETYKAGTVSNPKDILW

SEQ ID NO: 1371 - protein, 37 aa, Lactobacillus sakei
KYYGNGVSCNSHGCSVNWGQAWTCGVNHLANGGHGVC

SEQ ID NO: 1372 - protein, 37 aa, Lactobacillus plantarum
KYYGNGVTCGKHSCSVNWGQAFSCSVSHLANFGHGKC

SEQ ID NO: 1373 - protein, 37 aa, Lactobacillus plantarum
KYYGNGLSCSKKGCTVNWGQAFSCGVNRVATAGHHKC

SEQ ID NO: 1374 - protein, 44 aa, Enterococcus faecium
ATRSYGNGVYCNNSKCWVNWGEAKENIAGIVISGWASGLAGMGH

SEQ ID NO: 1375 - protein, 43 aa, Enterococcus faecalis
ATYYGNGLYCNKQKCWVDWNKASREIGKIIVNGWVQHGPWAPR

SEQ ID NO: 1376 - protein, 22 aa, Artificial Sequence
  synthetic antimicrobial peptide MSI-78, pexiganan, analog of magainin 2
GIGKFLKKAKKFGKAFVKILKK

SEQ ID NO: 1377 - protein, 24 aa, Artificial Sequence
  synthetic antimicrobial peptide MSI-594, analog of magainin 2 and melittin
GIGKFLKKAKKGIGAVLKVLTTGL

SEQ ID NO: 1378 - protein, 21 aa, Homo sapiens
SSMKLSFRARAYGFRGPGPQL

SEQ ID NO: 1379 - protein, 13 aa, Rana temporaria
LLPIVGNLLNSLL

SEQ ID NO: 1380 - protein, 10 aa, Rana temporaria
LSPNLLKSLL

SEQ ID NO: 1381 - protein, 24 aa, Amolops loloensis
FLPLAVSLAANFLPKLFCKITKKC

SEQ ID NO: 1382 - protein, 24 aa, Rana esculenta
FLPLLAGLAANFLPKIFCKITKRC

SEQ ID NO: 1383 - protein, 16 aa, Amolops loloensis
FLPIVGKLLSGLSGLL

SEQ ID NO: 1384 - protein, 13 aa, Rana areolata
FLPIVGRLISGLL

SEQ ID NO: 1385 - protein, 13 aa, Rana aurora
FLPIIGQLLSGLL

SEQ ID NO: 1386 - protein, 13 aa, Rana boylii
FLPIIAKVLSGLL

SEQ ID NO: 1387 - protein, 13 aa, Rana esculenta
FLPVIAGLLSKLF

SEQ ID NO: 1388 - protein, 13 aa, Rana japonica
ILPLVGNLLNDLL

SEQ ID NO: 1389 - protein, 13 aa, Rana pirica
ILPILGNLLNGLL

SEQ ID NO: 1390 - protein, 13 aa, Rana versabilis
FLPLVGKILSGLI

SEQ ID NO: 1391 - protein, 13 aa, Rana virgatipes
FLSSIGKILGNLL

SEQ ID NO: 1392 - protein, 13 aa, Rana virgatipes
FLSIIAKVLGSLF

SEQ ID NO: 1393 - protein, 21 aa, Rana japonica
FLGSLIGAAIPAIKQLLGLKK

SEQ ID NO: 1394 - protein, 24 aa, Rana boylii
FLPILASLAAKFGPKLFCLVTKKC

SEQ ID NO: 1395 - protein, 32 aa, Ixodes sinensis
QLKVDLWGTRSGIQPEQHSSGKSDVRRWRSRY

SEQ ID NO: 1396 - protein, 24 aa, Rana boylii
FLPILASLAAKLGPKLFCLVTKKC

SEQ ID NO: 1397 - protein, 24 aa, Rana boylii
FLPILASLAATLGPKLLCLITKKC

SEQ ID NO: 1398 - protein, 32 aa, Rana boylii
GILSTFKGLAKGVAKDLAGNLLDKFKCKITGC

SEQ ID NO: 1399 - protein, 28 aa, Rana boylii
GIMDSVKGLAKNLAGKLLDSLKCKITGC

SEQ ID NO: 1400 - protein, 24 aa, Myrmecia pilosula
IIGLVSKGTCVLVKTVCKKVLKQG

SEQ ID NO: 1401 - protein, 36 aa, Myrmecia pilosula
PDITKLNIKKLTKATCKVISKGASMCKVLFDKKKQE

SEQ ID NO: 1402 - protein, 37 aa, Myrmecia pilosula
DVKGMKKAIKGILDCVIEKGYDKLAAKLKKVIQQLWE

SEQ ID NO: 1403 - protein, 21 aa, Leptodactylus ocellatus
GLLDFVTGVGKDIFAQLIKQI

SEQ ID NO: 1404 - protein, 34 aa, Ophiophagus hannah
KRFKKFFKKLKNSVKKRAKKFFKKPRVIGVSIPF

SEQ ID NO: 1405 - protein, 34 aa, Bungarus fasciatus
KRFKKFFKKLKKSVKKRAKKFFKKPRVIGVSIPF

SEQ ID NO: 1406 - protein, 34 aa, Naja atra
KRFKKFFKKLKNSVKKRAKKFFKKPKVIGVTFPF

SEQ ID NO: 1407 - protein, 13 aa, Pelophylax saharica
FLSGIVGMLGKLF

SEQ ID NO: 1408 - protein, 13 aa, Pelophylax saharica
FLPIVTNLLSGLL

SEQ ID NO: 1409 - protein, 13 aa, Pelophylax saharica
FLSHIAGFLSNLF

SEQ ID NO: 1410 - protein, 20 aa, Impatiens balsamina
EWGRRCCGWGPGRRYCVRWC

SEQ ID NO: 1411 - protein, 20 aa, Impatiens balsamina
QYGRRCCNWGPGRRYCKRWC

SEQ ID NO: 1412 - protein, 45 aa, Euonymus europaeus
QQCGRQAGNRRCANNLCCSQYGYCGRTNEYCCTSQGCQSQCRRCG

SEQ ID NO: 1413 - protein, 38 aa, Phytolacca americana
AGCIKNGGRCNASAGPPYCCSSYCFQIAGQSYGVCKNR

SEQ ID NO: 1414 - protein, 37 aa, Phytolacca americana
ACIKNGGRCVASGGPPYCCSNYCLQIAGQSYGVCKKH

SEQ ID NO: 1415 - protein, 37 aa, Ornithodoros moubata
GYGCPFNQYQCHSHCRGIRGYKGGYCTGRFKQTCKCY

SEQ ID NO: 1416 - protein, 37 aa, Ornithodoros moubata
GYGCPFNQYQCHSHCSGIRGYKGGYCKGLFKQTCNCY

SEQ ID NO: 1417 - protein, 37 aa, Ornithodoros moubata
GFGCPFNQYECHAHCSGVPGYKGGYCKGLFKQTCNCY

SEQ ID NO: 1418 - protein, 58 aa, Butyrivibrium fibrisolvens
IYFIADKMGIQLAPAWYQDIVNWVSAGGTLTTGFAIIVGVTVPAWIAEAAAAFGIASA

SEQ ID NO: 1419 - protein, 80 aa, Enterococcus faecalis
ASLQFLPIAHMAKEFGIPAAVAGTVINVVEAGGWVTTIVSILTAVGSGGLSLLAAAGRESIKAYLKKEIKKKGKRAVIAW

SEQ ID NO: 1420 - protein, 58 aa, Lactobacillus gasseri; identical to SEQ ID NO: 1287

SEQ ID NO: 1421 - protein, 70 aa, Streptococcus uberis
LAGYTGIASGTAKKVVDAIDKGAAAFVIISIISTVISAGALGAVSASADFIILTVKNYISRNLKAQAVIW

SEQ ID NO: 1422 - protein, 58 aa, Lactobacillus acidophilus
IYWIADQFGIHLATGTARKLLDAVASGASLGTAFAAILGVTLPAWALAAAGALGATAA

SEQ ID NO: 1423 - protein, 40 aa, Phormia terranovae
ATCDLLSGTGINHSACAAHCLLRGNRGGYCNRKGVCVCRN

SEQ ID NO: 1424 - protein, 19 aa, Solanum tuberosum
RNCESLSHRFKGPCTRDSN

SEQ ID NO: 1425 - protein, 63 aa, Solanum tuberosum
GSNFCDSKCKLRCSKAGLADRCLKYCGICCEECKCVPSGTYGNKHECPCYRDKKNSKGKSKCP

SEQ ID NO: 1426 - protein, 66 aa, Solanum tuberosum
YSYKKIDCGGACAARCRLSSRPRLCNRACGTCCARCNCVPPGTSGNTETCPCYASLTTHGNKRKCP

SEQ ID NO: 1427 - protein, 52 aa, Spinacia oleracea
GIFSSRKCKTPSKTFKGICTRDSNCDTSCRYEGYPAGDCKGIRRRCMCSKPC

SEQ ID NO: 1428 - protein, 18 aa, Spinacia oleracea
GIFSNMYARTPAGYFRGP

SEQ ID NO: 1429 - protein, 34 aa, Lactococcus lactis
ITSISLCTPGCKTGVLMGCNLKTATCNCSVHVSK

SEQ ID NO: 1430 - protein, 44 aa, Tachypleus tridentatus
YSRCQLQGFNCVVRSYGLPTIPCCRGLTCRSYFPGSTYGRCQRF

SEQ ID NO: 1431 - protein, 41 aa, Tachypleus tridentatus
DYDWSLRGPPKCATYGQKCRTWSPRNCCWNLRCKAFRCRPR

SEQ ID NO: 1432 - protein, 20 aa, Lachesana tarabaevi
SWKSMAKKLKEYMEKLKQRA

SEQ ID NO: 1433 - protein, 20 aa, Lachesana tarabaevi
SWASMAKKLKEYMEKLKQRA

SEQ ID NO: 1434 - protein, 24 aa, Lachesana tarabaevi
GLKDKFKSMGEKLKQYIQTWKAKF

SEQ ID NO: 1435 - protein, 24 aa, Homo sapiens
SLKDKVKSMGEKLKQYIQTWKAKF

SEQ ID NO: 1436 - protein, 28 aa, Homo sapiens
GFFGKMKEYFKKFGASFKRRFANLKKRL

SEQ ID NO: 1437 - protein, 33 aa, Homo sapiens
QAFQTFKPDWNKIRYDAMKMQTSLGQMKKRFNL

SEQ ID NO: 1438 - protein, 34 aa, Lachesana tarabaevi
GETFDKLKEKLKTFYQKLVEKAEDLKGDLKAKLS

SEQ ID NO: 1439 - protein, 29 aa, Viola betenicifolia
VCGETCFGGTCNTPGCSCTWPICTRDGLP

SEQ ID NO: 1440 - protein, 35 aa, Mus musculus; identical to SEQ ID NO: 697

SEQ ID NO: 1441 - protein, 34 aa, Oryctolagus cuniculus
KPYCSCKWRCGIGEEEKGICHKFPIVTYVCCRRP

SEQ ID NO: 1442 - protein, 41 aa, Gallus gallus
DTLACRQSHGSCSFVACRAPSVDIGTCRGGKLKCCKWAPSS

SEQ ID NO: 1443 - protein, 41 aa, Gallus gallus
DTVACRIQGNFCRAGACPPTFTISGQCHGGLLNCCAKIPAQ

SEQ ID NO: 1444 - protein, 38 aa, Gallus gallus
IATQCRIRGGFCRVGSCRFPHIAIGKCATFISCCGRAY

SEQ ID NO: 1445 - protein, 39 aa, Lactococcus lactis
SIWGDIGQGVGKAAYWVGKAMGNMSDVNQASRINRKKKH

SEQ ID NO: 1446 - protein, 39 aa, Enterococcus faecalis
ESVFSKIGNAVGPAAYWILKGLGNMSDVNQADRINRKKH

SEQ ID NO: 1447 - protein, 26 aa, Lactobacillus plantarum
NKLAYNMGHYAGKATIFGLAAWALLA

SEQ ID NO: 1448 - protein, 37 aa, Artogeia rapae
KWKIFKKIEHMGQNIRDGLIKAGPAVQVVGQAATIYK

SEQ ID NO: 1449 - protein, 27 aa, Artificial Sequence
  synthetic antimicrobial peptide NK-2, Sus scrofa Nk-lysin, chain A, positions 39-65
KILRGLCKKIMRSFLRRISWDILTGKK

SEQ ID NO: 1450 - protein, 28 aa, Lactobacillus plantarum
LTTKLWSSWGYYLGKKARWNLKHPYVQF

SEQ ID NO: 1451 - protein, 60 aa, Carnobacterium maltaromaticum
LVAYGIAQGTAEKVVSLINAGLTVGSIISILGGVTVGLSGVFTAVKAAIAKQGIKKAIQL

SEQ ID NO: 1452 - protein, 48 aa, Lactobacillus johnsonii
NRWGDTVLSAASGAGTGIKACKSFGPWGMAICGVGGAAIGGYFGYTHN

SEQ ID NO: 1453 - protein, 59 aa, Brochothrix campestris
YSSKDCLKDIGKGIGAGTVAGAAGGGLAAGLGAIPGAFVGAHFGVIGGSAACIGGLLGN

SEQ ID NO: 1454 - protein, 62 aa, Streptococcus thermophilus
YSGKDCLKDMGGYALAGAGSGALWGAPAGGVGALPGAFVGAHVGAIAGGFACMGGMIGNKFN

SEQ ID NO: 1455 - protein, 45 aa, Lactobacillus salivarius
KRGPNCVGNFLGGLFAGAAAGVPLGPAGIVGGANLGMVGGALTCL

SEQ ID NO: 1456 - protein, 45 aa, Lactobacillus salivarius; identical to SEQ ID NO: 1455

SEQ ID NO: 1457 - protein, 44 aa, Streptococcus mutans
KVSGGEAVAAIGICATASAAIGGLAGATLVTPYCVGTWGLIRSH

SEQ ID NO: 1458 - protein, 33 aa, Lactobacillus casei
GMSGYIQGIPDFLKGYLHGISAANKHKKGRLGY

SEQ ID NO: 1459 - protein, 21 aa, Enterococcus faecalis
TTPACFTIGLGVGALFSAKFC

SEQ ID NO: 1460 - protein, 30 aa, Lactobacillus plantarum
FNRGGYNFGKSVRHVVDAIGSVAGILKSIR

SEQ ID NO: 1461 - protein, 25 aa, Lactobacillus plantarum
GAWKNFWSSLRKGFYDGEAGRAIRR

SEQ ID NO: 1462 - protein, 43 aa, Enterococcus faecium
NGVYCNKQKCWVDWSRARSEIIDRGVKAYVNGFTKVLGGIGGR

SEQ ID NO: 1463 - protein, 23 aa, Enterococcus faecalis
NPKVAHCASQIGRSTAWGAVSGA

SEQ ID NO: 1464 - protein, 30 aa, Lactobacillus curvatus
AYPGNGVHCGKYSCTVDKQTAIGNIGNNAA

SEQ ID NO: 1465 - protein, 70 aa, Enterococcus faecium
FTPSVSFSQNGGVVEAAAQRGYIYKKYPKGAKVPNKVKMLVNIRGKQTMRTCYLMSWTASSRTAKYYYYI

SEQ ID NO: 1466 - protein, 44 aa, Enterococcus faecium
ATYYGNGLYCNKEKCWVDWNQAKGEIGKIIVNGWVNHGPWAPRR

SEQ ID NO: 1467 - protein, 44 aa, Enterococcus faecium; identical to SEQ ID NO: 1466

SEQ ID NO: 1468 - protein, 53 aa, Enterococcus faecium
ENDHRMPNNLNRPNNLSKGGAKCGAAIAGGLFGIPKGPLAWAAGLANVYSKCN

SEQ ID NO: 1469 - protein, 58 aa, Lactobacillus acidophilus
KTYYGTNGVHCTKKSLWGKVRLKNVIPGTLCRKQSLPIKQDLKILLGWATGAFGKTFH

SEQ ID NO: 1470 - protein, 34 aa, Enterococcus faecium
MNFLKNGIAKWMTGAELQAYKKKYGCLPWEKISC

SEQ ID NO: 1471 - protein, 44 aa, Enterococcus faecalis
MLAKIKAMIKKFPNPYTLAAKLTTYEINWYKQQYGRYPWERPVA

SEQ ID NO: 1472 - protein, 44 aa, Enterococcus faecalis
APAGLVAKFGRPIVKKYYKQIMQFIGEGSAINKIIPWIARMWRT

SEQ ID NO: 1473 - protein, 44 aa, Enterococcus faecium
MGAIAKLVAKFGWPIVKKYYKQIMQFIGEGWAINKIIEWIKKHI

SEQ ID NO: 1474 - protein, 44 aa, Enterococcus faecalis
MGAIAKLVAKFGWPIVKKYYKQIMQFIGEGWAINKIIDWIKKHI

SEQ ID NO: 1475 - protein, 36 aa, Haloarchaeon
SDCNINSNTAADVILCFNQVGSCALCSPTLVGGPVP

SEQ ID NO: 1476 - protein, 76 aa, Halobacterium sp.
DIDITGCSACKYAAGQVCTIGCSAAGGFICGLLGITIPVAGLSCLGFVEIVCTVADEYSGCGDAVAKEACNRAGLC

SEQ ID NO: 1477 - protein, 30 aa, Homo sapiens
CSTNTFSLSDYWGNNGAWCTLTHECMAWCK

SEQ ID NO: 1478 - protein, 22 aa, Streptococcus salivarius
KRGSGWIATITDDCPNSVFVCC

SEQ ID NO: 1479 - protein, 44 aa, Klebsiella pneumoniae; identical to SEQ ID NO: 1466

SEQ ID NO: 1480 - protein, 44 aa, Enterococcus hirae; identical to SEQ ID NO: 1466

SEQ ID NO: 1481 - protein, 35 aa, Streptococcus thermophilus
LSCDEGMLAVGGLGAVGGPWGAAVGVLVGAALYCF

SEQ ID NO: 1482 - protein, 42 aa, Pediococcus pentosaceus
KYYGNGVHCGKKTCYVDWGQATASIGKIIVNGWTQHGPWAHR

SEQ ID NO: 1483 - protein, 25 aa, Streptococcus salivarius
GGGVIQTISHECRMNSWQFLFTCCS

SEQ ID NO: 1484 - protein, 27 aa, Lactobacillus lactis
KGGSGVIHTISHECNMNSWQFVFTCCS

SEQ ID NO: 1485 - protein, 27 aa, Lactobacillus lactis
KGGSGVIHTISHEVIYNSWNFVFTCCS

SEQ ID NO: 1486 - protein, 27 aa, Staphylococcus warneri
KKKSGVIPTVSHDCHMNSFQFVFTCCS

SEQ ID NO: 1487 - protein, 26 aa, Streptococcus pyogenes
GKNGVFKTISHECHLNTWAFLATCCS

SEQ ID NO: 1488 - protein, 8 aa, Apis mellifera
PFKLSLHL

SEQ ID NO: 1489 - protein, 9 aa, Apis mellifera
TPFKLSLHL

SEQ ID NO: 1490 - protein, 9 aa, Apis mellifera
EPFKLSLHL

SEQ ID NO: 1491 - protein, 93 aa, Apis mellifera
EFRGSIVIQGTKEGKSRPSLDIDYKQRVYDKNGMTGDAYGGLNIRPGQPSRQHAGFEFGKEYKNGFIKGQSEVQRGPGGRLSPYFGINGGFRF

SEQ ID NO: 1492 - protein, 23 aa, Ascaphus truei
GFRDVLKGAAKAFVKTVAGHIAN

SEQ ID NO: 1493 - protein, 24 aa, Ascaphus truei
GFRDVLKGAAKAFVKTVAGHIANI

SEQ ID NO: 1494 - protein, 24 aa, Ascaphus truei
GIKDWIKGAAKKLIKTVASNIANQ

SEQ ID NO: 1495 - protein, 24 aa, Ascaphus truei
GFKDWIKGAAKKLIKTVASSIANQ

SEQ ID NO: 1496 - protein, 19 aa, Ascaphus truei
GFKDLLKGAAKALVKTVLF

SEQ ID NO: 1497 - protein, 7 aa, Escherichia coli
MRTGNAD

SEQ ID NO: 1498 - protein, 43 aa, Escherichia coli
VGIGGGGGGGGGGSCGGQGGGCGGCSNGCSGGNGGSGGSGSHI

SEQ ID NO: 1499 - protein, 88 aa, Escherichia coli
ASGRDIAMAIGTLSGQFVAGGIGAAAGGVAGGAIYDYASTHKPNPAMSPSGLGGTIKQKPEGIPSEAWNYAAGRLCNWSPNNLSDVCL

SEQ ID NO: 1500 - protein, 90 aa, Escherichia coli
GDVNWVDVGKTVATNGAGVIGGAFGAGLCGPVCAGAFAVGSSAAVAALYDAAGNSNSAKQKPEGLPPEAWNYAEGRMCNWSPNNLSDVCL

SEQ ID NO: 1501 - protein, 77 aa, Escherichia coli
DGNDGQAELIAIGSLAGTFISPGFGSIAGAYIGDKVHSWATTATVSPSMSPSGIGLSSQFGSGRGTSSASSSAGSGS

SEQ ID NO: 1502 - protein, 60 aa, Escherichia coli
GGAPATSANAAGAAAIVGALAGIPGGPLGVVVGAVSAGLTTGIGSTVGSGSASSSAGGGS

SEQ ID NO: 1503 - protein, 62 aa, Escherichia coli
MNLNGLPASTNVIDLRGKDMGTYIDANGACWAPDTPSIIMYPGGSGPSYSMSSSTSSANSGS

SEQ ID NO: 1504 - protein, 19 aa, Verticimonosporium ellipticum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (19)...(19): Glu modified by 2-(2-amino-3-phenylpropylamino ethanol
XAXAXAQXFXGXXPVXXEE

SEQ ID NO: 1505 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XPXAXAQXVXGLXPVXXEQF

SEQ ID NO: 1506 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XPXAXAQXVXGLXPVXXQQF

SEQ ID NO: 1507 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XPXAXXQXVXGLXPVXXEQF

SEQ ID NO: 1508 - protein, 15 aa, Sepedonium ampullosporum
  MOD_RES (1)...(1): optionally N-acetyl-tryptophan
  MOD_RES (3)...(13): Xaa = alpha-aminoisobutyric acid (Aib)
  MOD_RES (15)...(15): optionally leucinol
WAXXLXQXXXQLXQL

SEQ ID NO: 1509 - protein, 15 aa, Sepedonium ampullosporum
  MOD_RES (1)...(1): optionally N-acetyl-tryptophan
  MOD_RES (3)...(13): Xaa = alpha-aminoisobutyric acid (Aib)
  MOD_RES (15)...(15): optionally leucinol
WAXXLXQAXXQLXQL

SEQ ID NO: 1510 - protein, 15 aa, Sepedonium ampullosporum
  MOD_RES (1)...(1): optionally N-acetyl-tryptophan
  MOD_RES (3)...(13): Xaa = alpha-aminoisobutyric acid (Aib)
  MOD_RES (15)...(15): optionally leucinol
WAXXLXQXAXQLXQL

SEQ ID NO: 1511 - protein, 15 aa, Sepedonium ampullosporum
  MOD_RES (1)...(1): optionally N-acetyl-tryptophan
  MOD_RES (3)...(13): Xaa = alpha-aminoisobutyric acid (Aib)
  MOD_RES (15)...(15): optionally leucinol
WAXXLXQXXAQLXQL

SEQ ID NO: 1512 - protein, 15 aa, Sepedonium ampullosporum
  MOD_RES (1)...(1): optionally N-acetyl-tryptophan
  MOD_RES (3)...(10): Xaa = alpha-aminoisobutyric acid (Aib)
  MOD_RES (15)...(15): optionally leucinol
WAXXLXQAXXQLAQL

SEQ ID NO: 1513 - protein, 15 aa, Sepedonium ampullosporum
  MOD_RES (1)...(1): optionally N-acetyl-tryptophan
  MOD_RES (3)...(13): Xaa = alpha-aminoisobutyric acid (Aib)
  MOD_RES (15)...(15): optionally leucinol
WAXXLXQXAAQLXQL

SEQ ID NO: 1514 - protein, 15 aa, Sepedonium ampullosporum
  MOD_RES (1)...(1): optionally N-acetyl-tryptophan
  MOD_RES (3)...(9): Xaa = alpha-aminoisobutyric acid (Aib)
  MOD_RES (15)...(15): optionally leucinol
WAXXLXQXXAQLAQL

SEQ ID NO: 1515 - protein, 15 aa, Sepedonium ampullosporum
  MOD_RES (1)...(1): optionally N-acetyl-tryptophan
  MOD_RES (3)...(13): Xaa = alpha-aminoisobutyric acid (Aib)
  MOD_RES (15)...(15): optionally leucinol
WAXXLXQAAXQLXQL

SEQ ID NO: 1516 - protein, 16 aa, Emericellopsis poonensis
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (8)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLXXXQXXXPF

SEQ ID NO: 1517 - protein, 16 aa, Emericellopsis poonensis
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (8)...(9): Xaa = alpha-aminoisobutyric acid (Aib)
  MOD_RES (10)...(10): Xaa= hydroxyproline (Hyp)
  MOD_RES (12)...(12): Xaa = isovaline (Iva)
  MOD_RES (14)...(14): Xaa = alpha-aminoisobutyric acid (Aib)
  MOD_RES (16)...(16): optionally phenylalaninol
FXXXXGLXXXQXPXPF

SEQ ID NO: 1518 - protein, 16 aa, Emericellopsis poonensis
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLXXXQXXXPF

SEQ ID NO: 1519 - protein, 16 aa, Emericellopsis poonensis
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (8)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLXXXQXXXPF

SEQ ID NO: 1520 - protein, 16 aa, Emericellopsis poonensis
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (8)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXALXXXQXXXPF

SEQ ID NO: 1521 - protein, 16 aa, Stilbella erythrocephala
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLXXXQXXXPF

SEQ ID NO: 1522 - protein, 16 aa, Stilbella erythrocephala
  MOD_RES (1)...(1): optionally N-acetyl-phenylalanine
  MOD_RES (3)...(3): Xaa = alpha-aminoisobutyric acid (Aib)
  MOD_RES (4)...(4): Xaa = isovaline (Iva)
  MOD_RES (5)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FAXXXGLXXXQXXXPF

SEQ ID NO: 1523 - protein, 16 aa, Stilbella erythrocephala
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (8)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalininol
FXXXXGLXXXQXXXPF

SEQ ID NO: 1524 - protein, 16 aa, Stilbella erythrocephala
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (8)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXAXXGLXXXQXXXPF

SEQ ID NO: 1525 - protein, 16 aa, Stilbella erythrocephala
  MOD_RES (1)...(1): optionally N-acetyl-phenylalanine
  MOD_RES (2)...(4): Xaa = alpha-aminoisobutyric acid (Aib)
  MOD_RES (5)...(8): Xaa = isovaline (Iva)
  MOD_RES (9)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLXXXQXXXPF

SEQ ID NO: 1526 - protein, 16 aa, Stilbella erythrocephala
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (0)...(0): optionally phenylalaninol
FXXXXALXXXQXXXPF

SEQ ID NO: 1527 - protein, 16 aa, Stilbella erythrocephala
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLAXXQXXXPF

SEQ ID NO: 1528 - protein, 16 aa, Stilbella erythrocephala
  MOD_RES (1)...(1): optionally N-acetyl-valine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
VXXXXGLXXXQXXXPF

SEQ ID NO: 1529 - protein, 16 aa, Stilbella erythrocephala
  MOD_RES (1)...(1): optionally N-acetyl-valine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
VXXXVGLXXXQXXXPF

SEQ ID NO: 1530 - protein, 16 aa, Stilbella erythrocephala
  MOD_RES (1)...(1): optionally N-acetyl-leucine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (0)...(0): optionally phenylalaninol
LXXXXGLXXXQXXXPF

SEQ ID NO: 1531 - protein, 16 aa, Stilbella erythrocephala
  MOD_RES (1)...(1): optionally N-acetyl-leucine
  MOD_RES (2)...(4): Xaa = alpha-aminoisobutyric acid (Aib)
  MOD_RES (5)...(5): Xaa = isovaline (Iva)
  MOD_RES (8)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
LXXXXGLXXXQXXXPF

SEQ ID NO: 1532 - protein, 20 aa, Trichoderma atroviride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XPXAXAQXVXGLXPVXXQQF

SEQ ID NO: 1533 - protein, 20 aa, Trichoderma atroviride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XPXAXAQXVXGLXPVXXQQF

SEQ ID NO: 1534 - protein, 20 aa, Trichoderma atroviride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XPXAXXQXVXGLXPVXXQQF

SEQ ID NO: 1535 - protein, 15 aa, Emericellopsis donezkii
  MOD_RES (1)...(1): optionally N-acetyl-valine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (15)...(15): optionally phenylalaninol
VXXXVGLXXXQXXXF

SEQ ID NO: 1536 - protein, 15 aa, Emericellopsis donezkii
  MOD_RES (1)...(1): optionally N-acetyl-valine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (15)...(15): optionally phenylalaninol
VXXXVGLVXXQXXXF

SEQ ID NO: 1537 - protein, 15 aa, Emericellopsis donezkii
  MOD_RES (1)...(1): optionally N-acetyl-valine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (15)...(15): optionally phenylalaninol
VXXXVGLXXXQXXXF

SEQ ID NO: 1538 - protein, 14 aa, Emericellopsis donezkii
  MOD_RES (1)...(1): optionally N-acetyl-valine
  MOD_RES (2)...(8): Xaa = alpha-aminoisobutyric acid (Aib)
  MOD_RES (9)...(9): Xaa = hydroxyproline (Hyp)
  MOD_RES (11)...(11): Xaa = alpha-aminoisobutyric acid (Aib)
  MOD_RES (12)...(12): Xaa = hydroxyproline (Hyp)
  MOD_RES (13)...(13): Xaa = alpha-aminoisobutyric acid (Aib)
  MOD_RES (14)...(14): optionally phenylalaninol
VXXVGLXXXQXXXF

SEQ ID NO: 1539 - protein, 19 aa, Boletus sp.
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (9)...(17): Xaa = alpha-aminoisobutyric acid (Aib)
  MOD_RES (19)...(19): optionally tryptophanol
FXAXXLQGXXAAXPXXXQW

SEQ ID NO: 1540 - protein, 16 aa, Acremonium tubakii
  MOD_RES (1)...(1): optionally N-acetyl-phenylalanine
  MOD_RES (2)...(5): Xaa = alpha-aminoisobutyric acid (Aib)
  MOD_RES (8)...(8): Xaa = isovaline (Iva)
  MOD_RES (9)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLXXXQXXXPF

SEQ ID NO: 1541 - protein, 16 aa, Acremonium tubakii
  MOD_RES (1)...(1): optionally N-acetyl-phenylalanine
  MOD_RES (2)...(5): Xaa = alpha-aminoisobutyric acid (Aib)
  MOD_RES (8)...(8): Xaa = isovaline (Iva)
  MOD_RES (9)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXALXXXQXXXPF

SEQ ID NO: 1542 - protein, 16 aa, Acremonium tubakii
  MOD_RES (1)...(1): optionally N-acetyl-phenylalanine
  MOD_RES (2)...(4): Xaa = alpha-aminoisobutyric acid (Aib)
  MOD_RES (5)...(8): Xaa = isovaline (Iva)
  MOD_RES (9)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): optionally phenylalaninol
FXXXXGLXXXQXXXPF

SEQ ID NO: 1543 - protein, 16 aa, Acremonium tubakii
  MOD_RES (1)...(1): optionally N-acetyl-phenylalanine
  MOD_RES (2)...(5): Xaa = alpha-aminoisobutyric acid (Aib)
  MOD_RES (8)...(8): Xaa = isovaline (Iva)
  MOD_RES (9)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLXXXQXXXPF

SEQ ID NO: 1544 - protein, 16 aa, Acremonium tubakii
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLXXXQXXXPF

SEQ ID NO: 1545 - protein, 16 aa, Acremonium tubakii
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
FXXXXGLXXXQXXXPF

SEQ ID NO: 1546 - protein, 17 aa, Acremonium tubakii
  MOD_RES (1)...(1): optionally N-acety-phenylalanine
  MOD_RES (2)...(2): Xaa = isovaline
  MOD_RES (4)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (17)...(17): optionally serinol
FXQXITXLXXQXXXPFS

SEQ ID NO: 1547 - protein, 17 aa, Acremonium tubakii
  MOD_RES (1)...(1): optionally N-acetyl-phenylalanine
  MOD_RES (2)...(2): Xaa = isovaline (Iva)
  MOD_RES (4)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (17)...(17): optionally serinol
FXQXITXLXPQXXXPFS

SEQ ID NO: 1548 - protein, 12 aa, Mycogone cervina
  MOD_RES (1)...(1): optionally N-acetyl-leucine
  MOD_RES (2)...(9): Xaa = alpha-aminoisobutyric acid (Aib)
  MOD_RES (12)...(12): optionally leucinol
LXPXLXPAXPVL

SEQ ID NO: 1549 - protein, 12 aa, Mycogone cervina
  MOD_RES (1)...(1): optionally N-acetyl-leucine
  MOD_RES (2)...(9): Xaa = alpha-aminoisobutyric acid (Aib)
  MOD_RES (12)...(12): optionally acetylated leucinol
LXPXLXPAXPVL

SEQ ID NO: 1550 - protein, 19 aa, Apiocrea chrysosperma
  MOD_RES (1)...(1): optionally N-acetyl-phenylalanine
  MOD_RES (2)...(17): Xaa = alpha-aminoisobutyric acid (Aib)
  MOD_RES (19)...(19): optionally tryptophanol
FXSXXLQGXXAAXPXXXQW

SEQ ID NO: 1551 - protein, 19 aa, Apiocrea chrysosperma
  MOD_RES (1)...(1): optionally N-acetyl-phenylalanine
  MOD_RES (2)...(13): Xaa = alpha-aminoisobutyric acid (Aib)
  MOD_RES (15)...(15): Xaa = isovaline (Iva)
  MOD_RES (16)...(17): Xaa = alpha-aminoisobutyric acid (Aib)
  MOD_RES (19)...(19): optionally tryptphanol
FXSXXLQGXXAAXPXXXQW

SEQ ID NO: 1552 - protein, 19 aa, Apiocrea chrysosperma
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (9)...(17): Xaa = alpha-aminoisobutyric acid (Aib)
  MOD_RES (19)...(19): optionally tryptophanol
FXSXXLQGXXAAXPXXXQW

SEQ ID NO: 1553 - protein, 19 aa, Apiocrea chrysosperma
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (9)...(13): Xaa = alpha-aminoisobutyric acid (Aib)
  MOD_RES (15)...(15): Xaa = isovaline (Iva)
  MOD_RES (16)...(17): Xaa = alpha-aminoisobutyric acid (Aib)
  MOD_RES (19)...(19): optionally tryptophanol
FXSXXLQGXXAAXPXXXQW

SEQ ID NO: 1554 - protein, 14 aa, Clonostachys sp.
  MOD_RES (1)...(1): Xaa = optionally N-acetyl-alpha-aminoisobutyric acid (Ac-Aib) or alpha-aminoisobutyric acid (Aib)
  MOD_RES (2)...(2): Xaa = hydroxyproline (Hyp)
  MOD_RES (4)...(4): Xaa = isovaline (Iva)
  MOD_RES (5)...(5): Xaa = hydroxyproline (Hyp)
  MOD_RES (7)...(7): Xaa = isovaline (Iva)
  MOD_RES (8)...(8): Xaa = hydroxyproline (Hyp)
  MOD_RES (9)...(9): Xaa = alpha-aminoisobutyric acid (Aib)
  MOD_RES (10)...(10): Xaa = hydroxyproline (Hyp)
  MOD_RES (11)...(11): Xaa = alpha-aminoisobutyric acid (Aib)
  MOD_RES (12)...(12): Xaa = hydroxyproline (Hyp)
  MOD_RES (13)...(13): Xaa = isovaline (Iva)
  MOD_RES (14)...(14): optionally isoleucine modified by esterified mannitol
XXLXXLXXXXXXXI

SEQ ID NO: 1555 - protein, 16 aa, Emericellopsis microspora
  MOD_RES (1)...(1): optionally N-acetyl-tryptophan
  MOD_RES (4)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIQXITXLXXQXXXPF

SEQ ID NO: 1556 - protein, 16 aa, Emericellopsis microspora
  MOD_RES (1)...(1): optionally N-acetyl-tryptophan
  MOD_RES (4)...(4): Xaa = isovaline (Iva)
  MOD_RES (7)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIQXITXLXXQXXXPF

SEQ ID NO: 1557 - protein, 15 aa, Emericellopsis microspora
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (15)...(15): optionally phenylalaninol
FXXXVGLXXXQXXXF

SEQ ID NO: 1558 - protein, 15 aa, Emericellopsis microspora
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (15)...(15): optionally phenylalaninol
FXXXVGLXXXQXXAF

SEQ ID NO: 1559 - protein, 11 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  MOD_RES (7)...(7): Xaa = isovaline (Iva)
  MOD_RES (9)...(9): Xaa = alpha-aminoisobutyric acid (Aib)
  MOD_RES (11)...(11): optionally leucinol
XNLIXPXLXPL

SEQ ID NO: 1560 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(12): Xaa = alpha-aminoisobutyric acid (Aib)
  MOD_RES (14)...(14): optionally leucinol
XNLXPSVXPXLXPL

SEQ ID NO: 1561 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (10)...(10): Xaa = isovaline (Iva)
  MOD_RES (12)...(12): Xaa = alpha-aminoisobutyric acid (Aib)
  MOD_RES (14)...(14): optionally leucinol
XNLXPSVXPXLXPL

SEQ ID NO: 1562 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (10)...(10): Xaa = isovaline (Iva)
  MOD_RES (12)...(12): Xaa = alpha-aminoisobutyric acid (Aib)
  MOD_RES (14)...(14): optionally leucinol
XNLXPAIXPXLXPL

SEQ ID NO: 1563 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(12): Xaa = alpha-aminoisobutyric acid (Aib)
  MOD_RES (14)...(14): optionally leucinol
XNLXPAVXPXLXPL

SEQ ID NO: 1564 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (10)...(10): Xaa = isovaline (Iva)
  MOD_RES (12)...(12): Xaa = alpha-aminoisobutyric acid (Aib)
  MOD_RES (14)...(14): optionally leucinol
XNLXPAVXPXLXPL

SEQ ID NO: 1565 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (10)...(10): Xaa = isovaline (Iva)
  MOD_RES (12)...(12): Xaa = alpha-aminoisobutyric acid (Aib)
  MOD_RES (14)...(14): optionally leucinol
XNLXPAVXPXLXPL

SEQ ID NO: 1566 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (10)...(10): Xaa = isovaline (Iva)
  MOD_RES (12)...(12): Xaa = alpha-aminoisobutyric acid (Aib)
  MOD_RES (14)...(14): optionally leucinol
XQLXPAVXPXLXPL

SEQ ID NO: 1567 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(12): Xaa = alpha-aminoisobutyric acid (Aib)
  MOD_RES (14)...(14): optionally leucinol
XNLXPSIXPXLXPL

SEQ ID NO: 1568 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (10)...(10): Xaa = isovaline (Iva)
  MOD_RES (12)...(12): Xaa = alpha-aminoisobutyric acid (Aib)
  MOD_RES (14)...(14): optionally leucinol
XNLXPSIXPXLXPL

SEQ ID NO: 1569 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (10)...(10): Xaa - isovaline (Iva)
  MOD_RES (12)...(12): Xaa = alpha-aminoisobutyric acid (Aib)
  MOD_RES (14)...(14): optionally leucinol
XQLXPSIXPXLXPL

SEQ ID NO: 1570 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(12): Xaa = alpha-aminoisobutyric acid (Aib)
  MOD_RES (14)...(14): optionally leucinol
XNLXPAIXPXLXPL

SEQ ID NO: 1571 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (10)...(10): Xaa = isovaline (Iva)
  MOD_RES (12)...(12): Xaa = alpha-aminoisobutyric acid (Aib)
  MOD_RES (14)...(14): optionally leucinol
XQLXPAIXPXLXPL

SEQ ID NO: 1572 - protein, 11 aa, Trichoderma pseudokoningii
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally leucinol
XNIIXPLLXPL

SEQ ID NO: 1573 - protein, 14 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(12): Xaa = alpha-aminoisobutyric acid (Aib)
  MOD_RES (14)...(14): optionally valinol
XNLXPSIXPXLXPV

SEQ ID NO: 1574 - protein, 8 aa, Mycogone rosea
  MOD_RES (1)...(1): Pro modified by 2-methyloctanoic acid (MOA)
  MOD_RES (2)...(2): Xaa = 2-amino-4-methyl-6-hydroxy-8-oxo-decanoic acid (AHMOD)
  MOD_RES (4)...(7): Xaa = alpha-aminoisobutyric acid (Aib)
  MOD_RES (8)...(8): Xaa = alpha-aminoisobutyric acid (Aib) modified by 2-(2'-aminopropyl)-aminoethanol (AAE)
PXAXIIXX

SEQ ID NO: 1575 - protein, 8 aa, Mycogone rosea
  MOD_RES (1)...(1): Pro modified by 2-methyloctanoic acid (MOA)
  MOD_RES (2)...(2): Xaa = 2-amino-4-methyl-6-hydroxy 8-oxo-decanoic acid (AHMOD)
  MOD_RES (4)...(7): Xaa = alpha-aminoisobutyric acid (Aib)
  MOD_RES (8)...(8): Xaa = alpha-aminoisobutyric acid (Aib) modified by 2-[(2'-aminopropyl)-methylamino]-ethanol (AMAE)
PXAXIIXX

SEQ ID NO: 1576 - protein, 15 aa, Emericellopsis sp.
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (15)...(15): optionally phenylalaninol
FXXXVGLXXXQXXXF

SEQ ID NO: 1577 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXXQLXGXXXPVXXQQL

SEQ ID NO: 1578 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXXQXLXGXXPVXXQQL

SEQ ID NO: 1579 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXAQXLXGXXPVXXQQL

SEQ ID NO: 1580 - protein, 19 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (19)...(19): Gln modified by amino alcohol [C7H16NO] of unknown structure
XPXAXXQXLXGXXPVXXQQ

SEQ ID NO: 1581 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXXQXIXGXXPVXXQQL

SEQ ID NO: 1582 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally leucinol
XPXAXXQXLXGXXPVXXQQL

SEQ ID NO: 1583 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally leucinol
XPXAXXQXIXGXXPVXXQQL

SEQ ID NO: 1584 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally isoleucinol
XPXAXXQXLXGXXPVXXQQI

SEQ ID NO: 1585 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally isoleucinol
XPXAXAQXLXGXXPVXXQQI

SEQ ID NO: 1586 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally leucinol
XPXAXAQXLXGXXPVXXQQL

SEQ ID NO: 1587 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXAQXIXGXXPVXXQQL

SEQ ID NO: 1588 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXXQXLXGXXPVXXEQL

SEQ ID NO: 1589 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXAQXLXGXXPVXXEQL

SEQ ID NO: 1590 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally leucinol
XPXAXXQXLXGXXPVXXEQL

SEQ ID NO: 1591 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXXQXIXGXXPVXXEQL

SEQ ID NO: 1592 - protein, 20 aa, Hypocrea peltata
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally isoleucinol
XPXAXXQXLXGXXPVXXEQI

SEQ ID NO: 1593 - protein, 11 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally leucinol
XQVVXPLLXPL

SEQ ID NO: 1594 - protein, 11 aa, Hypocrea muroiana
  MOD_RES (1)...(1): Xaa = optionally N-acetyl-isovaline (Ac-Iva) or isovaline (Iva)
  MOD_RES (5)...(9): Xaa = alpha-aminoisobutyric acid (Aib)
  MOD_RES (11)...(11): optionally leucinol
XQVVXPLLXPL

SEQ ID NO: 1595 - protein, 11 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally leucinol
XQVLXPLIXPL

SEQ ID NO: 1596 - protein, 11 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally leucinol
XQIVXPLLXPL

SEQ ID NO: 1597 - protein, 11 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally leucinol
XQIIXPLLXPL

SEQ ID NO: 1598 - protein, 11 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally leucinol
XQILXPLIXPL

SEQ ID NO: 1599 - protein, 18 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(16): Xaa = alpha-aminoisobutyric acid (Aib)
  MOD_RES (18)...(18): optionally valinol
XSALXQXVXGXXPLXXQV

SEQ ID NO: 1600 - protein, 18 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(16): Xaa = alpha-aminoisobutyric acid (Aib)
  MOD_RES (18)...(18): optionally leucinol
XSALXQXVXGXXPLXXQL

SEQ ID NO: 1601 - protein, 18 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(16): Xaa = optionally N-acetyl-alpha-aminoisobutyric acid (Ac-Aib) or alpha-aminoisobutyric acid (Aib)
  MOD_RES (18)...(18): optionally valinol
XAALXQXVXGXXPLXXQV

SEQ ID NO: 1602 - protein, 18 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  MOD_RES (7)...(7): Xaa = isovaline (Iva)
  MOD_RES (9)...(16): Xaa = alpha-aminoisobutyric acid (Aib)
  MOD_RES (18)...(18): optionally valinol
XSALXQXVXGXXPLXXQV

SEQ ID NO: 1603 - protein, 18 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally valinol
XSALXQXVXGXXPLXXQV

SEQ ID NO: 1604 - protein, 18 aa, Hypocrea muroiana
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XSALXQXVXGXXPLXXQL

SEQ ID NO: 1605 - protein, 16 aa, Emericellopsis salmosynnemata
  MOD_RES (1)...(1): optionally N-acetyl-leucine
  MOD_RES (4)...(4): Xaa = isovaline (Iva)
  MOD_RES (7)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
LIQXITXLXXQXXXPF

SEQ ID NO: 1606 - protein, 20 aa, Trichoderma longhibrachitum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXVXGLXPVXXQQF

SEQ ID NO: 1607 - protein, 20 aa, Trichoderma longhibrachitum
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXVXGLXPVXXQQF

SEQ ID NO: 1608 - protein, 20 aa, Trichoderma longhibrachitum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXXQXVXGLXPVXXQQF

SEQ ID NO: 1609 - protein, 20 aa, Trichoderma longhibrachitum
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXXQXVXGLXPVXXQQF

SEQ ID NO: 1610 - protein, 20 aa, Trichoderma longhibrachitum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXVXGLXPVXXEQF

SEQ ID NO: 1611 - protein, 20 aa, Trichoderma longhibrachitum
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXVXGLXPVXXEQF

SEQ ID NO: 1612 - protein, 11 aa, Tolypocladium geodes
  MOD_RES (1)...(1): Xaa = optionally N-octyl-alpha-aminoisobutyric acid (Ac-Aib) or alpha-aminoisobutyric acid (Aib)
  MOD_RES (4)...(7): Xaa = alpha-aminoisobutyric acid (Aib)
  MOD_RES (8)...(8): Xaa = ethylnorvaline (EtNor)
  MOD_RES (11)...(11): optionally leucinol
XPYXQQXXQAL

SEQ ID NO: 1613 - protein, 11 aa, Tolypocladium geodes
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (11)...(11): optionally leucinol
XPFXQQXXQAL

SEQ ID NO: 1614 - protein, 11 aa, Tolypocladium geodes
  MOD_RES (1)...(1): Xaa = optionally N-octyl-alpha-aminoisobutyric acid (Oc-Aib) or alpha-aminoisobutyric acid (Aib)
  MOD_RES (4)...(7): Xaa = alpha-aminoisobutyric acid (Aib)
  MOD_RES (8)...(8): Xaa = ethylnorvaline (EtNor)
  MOD_RES (11)...(11): optionally leucinol
XPFXQQXXQAL

SEQ ID NO: 1615 - protein, 12 aa, Thichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(9): Xaa = alpha-aminoisobutyric acid (Aib)
  MOD_RES (12)...(12): Xaa = optionally alpha-aminoisobutyric acid (Aib) or methoxy-alpha-aminoisobutyric acid (Aib-OCH3)
XAAXXQXXXSLX

SEQ ID NO: 1616 - protein, 20 aa, Thrichoderma reesei
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXVXGXXPVXXQQF

SEQ ID NO: 1617 - protein, 20 aa, Thrichoderma reesei
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXLXGXXPVXXQQF

SEQ ID NO: 1618 - protein, 20 aa, Thrichoderma reesei
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXXQXVXGXXPVXXQQF

SEQ ID NO: 1619 - protein, 20 aa, Thrichoderma reesei
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXXQXLXGXXPVXXQQF

SEQ ID NO: 1620 - protein, 20 aa, Trichoderma saturnisporum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXLXGXAPVXXQQF

SEQ ID NO: 1621 - protein, 5 aa, Sepedonium sp.
  MOD_RES (1)...(1): optionally N-acetyl-leucine
  MOD_RES (2)...(4): Xaa = alpha-aminoisobutyric acid (Aib)
  MOD_RES (5)...(5): optionally phenylalaninol
LXLXF

SEQ ID NO: 1622 - protein, 19 aa, Trichoderma sp.
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (9)...(13): Xaa = alpha-aminoisobutyric acid (Aib)
  MOD_RES (15)...(15): Xaa = isovaline (Iva)
  MOD_RES (16)...(17): Xaa = alpha-aminoisobutyric acid (Aib)
  MOD_RES (19)...(19): optionally tryptophanol
FXAXXLQGXXAAXPXXXQW

SEQ ID NO: 1623 - protein, 19 aa, Trichoderma sp.
  MOD_RES (1)...(1): optionally N-acetyl-phenylalanine
  MOD_RES (2)...(4): Xaa = alpha-aminoisobutyric acid (Aib)
  MOD_RES (5)...(5): Xaa = isovaline (Iva)
  MOD_RES (9)...(13): Xaa = alpha-aminoisobutyric acid (Aib)
  MOD_RES (15)...(15): Xaa = isovaline (Iva)
  MOD_RES (16)...(17): Xaa = alpha-aminoisobutyric acid (Aib)
  MOD_RES (19)...(19): optionally phenylalaninol
FXSXXLQGXXAAXPXXXQF

SEQ ID NO: 1624 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XPXAXXQXVXGVXPVXXQQF

SEQ ID NO: 1625 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XPXAXXQXVXGLXPVXXQQF

SEQ ID NO: 1626 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XPXAXXQXIXGLXPVXXQQF

SEQ ID NO: 1627 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (20)...(20): optionally phenylalaninol
XPXAXXQXIXGLXPVXVQQF

SEQ ID NO: 1628 - protein, 10 aa, Trichoderma pseudokoningii
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (10)...(10): prolinamide
XNIIXPLLXP

SEQ ID NO: 1629 - protein, 8 aa, Trichoderma pseudokoningii
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  MOD_RES (8)...(8): valine modified by hydroxyketopiperazine
XNIIXPLV

SEQ ID NO: 1630 - protein, 15 aa, Emericellopsis microspora
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (15)...(15): optionally phenylalaninol
FXXXVGLXXXQXXAF

SEQ ID NO: 1631 - protein, 15 aa, Emericellopsis microspora
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (15)...(15): optionally phenylalaninol
FXXXVGLXXXQXXXF

SEQ ID NO: 1632 - protein, 20 aa, Trichoderma saturnisporum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): Xaa = phenylalaninol
XAXAXAQXLXGXXPVXXQQF

SEQ ID NO: 1633 - protein, 20 aa, Trichoderma saturnisporum
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXLXGXXPVXXQQF

SEQ ID NO: 1634 - protein, 20 aa, Trichoderma saturnisporum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = optionally N-acetyl-alpha-aminoisobutyric acid (Ac-Aib) or alpha-aminoisobutyric acid (Aib)
  MOD_RES (20)...(20): optionally phenylalaninol
XAXAXXQXLXGXXPVXXQQF

SEQ ID NO: 1635 - protein, 20 aa, Trichoderma saturnisporum
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXXQXLXGXXPVXXQQF

SEQ ID NO: 1636 - protein, 15 aa, Emericellopsis microspora
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (15)...(15): optionally phenylalaninol
FXXXVGLXXXQXXAF

SEQ ID NO: 1637 - protein, 15 aa, Emericellopsis microspora
  MOD_RES (1)...(1): optionally N-acetyl-phenylalanine
  MOD_RES (2)...(9): Xaa = alpha-aminoisobutyric acid (Aib)
  MOD_RES (10)...(10): Xaa = hydroxyproline (Hyp)
  MOD_RES (12)...(12): Xaa = isovaline (Iva)
  MOD_RES (13)...(13): Xaa = hydroxyproline (Hyp)
  MOD_RES (14)...(14): Xaa = alpha-aminoisobutyric acid (Aib)
  MOD_RES (15)...(15): optionally phenylalaninol
FXXXVGLXXXQXXXF

SEQ ID NO: 1638 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally valinol
XPXAXAQXVXGXXPVXXEQV

SEQ ID NO: 1639 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally valinol
XPXAXAQXLXGXXPVXXEQV

SEQ ID NO: 1640 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXXQXVXGXAPVXXEQL

SEQ ID NO: 1641 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXAQXLXGXXPVXXEQL

SEQ ID NO: 1642 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = optionally N-acetyl-alpha-aminoisobutyric acid (Ac-Aib) or alpha-aminoisobutyric acid (Aib)
  MOD_RES (20)...(20): optionally valaninol
XPXAXXQXLXGXXPVXXEQV

SEQ ID NO: 1643 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): Xaa = optionally isovaline (Iva) or isovalinol (Iva-OH)
XPXAXAQXLXGXXPVXXEQX

SEQ ID NO: 1644 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally isoleucinol
XPXAXXQXLXGXXPVXXEQI

SEQ ID NO: 1645 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally valinol
XPXAXAQXVXGXXPVXXQQV

SEQ ID NO: 1646 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally valinol
XPXAXAQXLXGXXPVXXQQV

SEQ ID NO: 1647 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXAQXVXGXXPVXXQQL

SEQ ID NO: 1648 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXAQXLXGXXPVXXQQL

SEQ ID NO: 1649 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally valinol
XPXAXXQXLXGXXPVXXQQV

SEQ ID NO: 1650 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = optionally N-acetyl-alpha-aminoisobutyric acid (Ac-Aib) or alpha-aminoisobutyric acid (Aib)
  MOD_RES (20)...(20): optionally valinol
XPXAXXQXVXGXXPVXXQQV

SEQ ID NO: 1651 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXXQXLXGXXPVXXQQL

SEQ ID NO: 1652 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally leucinol
XPXAXXQXVXGXXPVXXQQL

SEQ ID NO: 1653 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally isoleucinol
XPXAXXQXLXGXXPVXXQQI

SEQ ID NO: 1654 - protein, 20 aa, Silbella flavipes
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally isoleucinol
XPXAXXQXVXGXXPVXXQQI

SEQ ID NO: 1655 - protein, 20 aa, Thrichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXXXGLXPVXXQQF

SEQ ID NO: 1656 - protein, 11 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally leucinol
XNLLXPLXXPL

SEQ ID NO: 1657 - protein, 11 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally valinol
XNLLXPVLXPV

SEQ ID NO: 1658 - protein, 11 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally valinol
XNVLXPLLXPV

SEQ ID NO: 1659 - protein, 11 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally valinol
XNLVXPLLXPV

SEQ ID NO: 1660 - protein, 11 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  MOD_RES (11)...(11): optionally leucinol
XNLLXPVXVPL

SEQ ID NO: 1661 - protein, 11 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  MOD_RES (11)...(11): optionally leucinol
XNVLXPLXVPL

SEQ ID NO: 1662 - protein, 11 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  MOD_RES (11)...(11): optionally leucinol
XNLVXPLXVPL

SEQ ID NO: 1663 - protein, 11 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  MOD_RES (11)...(11): optionally valinol
XNLLXPLXVPV

SEQ ID NO: 1664 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXLXGXXPVXXQQF

SEQ ID NO: 1665 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXLXGXXPVXXQQF

SEQ ID NO: 1666 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXIXGXXPVXXQQF

SEQ ID NO: 1667 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXIXGXXPVXXQQF

SEQ ID NO: 1668 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXLXGLXPVXXQQF

SEQ ID NO: 1669 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXLXGLXPVXXQQF

SEQ ID NO: 1670 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXIXGLXPVXXQQF

SEQ ID NO: 1671 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXIXGLXPVXXQQF

SEQ ID NO: 1672 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXLXGXXPVXXEQF

SEQ ID NO: 1673 - protein, 20 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXLXGXXPVXXEQF

SEQ ID NO: 1674 - protein, 7 aa, Trichoderma viride
  MOD_RES (1)...(1): (Z)-4-decenoyl-glycine
  MOD_RES (4)...(4): Xaa = alpha-aminoisobutyric acid (Aib)
  MOD_RES (7)...(7): optionally leucinol
GGLXGIL

SEQ ID NO: 1675 - protein, 7 aa, Trichoderma viride
  MOD_RES (1)...(1): (Z)-4-decenoyl-glycine
  MOD_RES (4)...(4): Xaa = alpha-aminoisobutyric acid (Aib)
  MOD_RES (7)...(7): optionally leucinol
GGLXGLL

SEQ ID NO: 1676 - protein, 11 aa, Trichoderma longibrachiatum
  MOD_RES (1)...(1): Xaa = optionally octyl-alpha-aminoisobutyric acid (Ac-Aib) or alpha-aminoisobutyric acid (Aib)
  MOD_RES (4)...(8): Xaa = alpha-aminoisobutyric acid (Aib)
  MOD_RES (11)...(11): optionally leucinol
XGLXGGLXGIL

SEQ ID NO: 1677 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(5): Xaa = alpha-aminoisobutyric acid (Aib)
  MOD_RES (7)...(7): Xaa = isovaline (Iva)
  MOD_RES (9)...(16): Xaa = alpha-aminoisobutyric acid (Aib)
  MOD_RES (18)...(18): optionally isoleucinol
XSAXXQXLXAXXPLXXQI

SEQ ID NO: 1678 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(16): Xaa = alpha-aminoisobutyric acid (Aib)
XSAXXQXLXAXXPLXXQI

SEQ ID NO: 1679 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally isoleucinol
XSAXXQXLXAXXPLXXQI

SEQ ID NO: 1680 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(7): Xaa = isovaline (Iva)
  MOD_RES (9)...(16): Xaa = alpha-aminoisobutyric acid (Aib)
  MOD_RES (18)...(18): optionally leucinol
XSAXXQXLXAXXPLXXQL

SEQ ID NO: 1681 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(5): Xaa = alpha-aminoisobutyric acid (Aib)
  MOD_RES (7)...(7): Xaa = isovaline (Iva)
  MOD_RES (9)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XSAXXQXLXAXXPLXXQL

SEQ ID NO: 1682 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XSAXXQXLXAXXPLXXQL

SEQ ID NO: 1683 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(7): Xaa = isovaline (Iva)
  MOD_RES (9)...(16): Xaa = alpha-aminoisobutyric acid (Aib)
  MOD_RES (18)...(18): optionally isoleucinol
XSAXXQXLXAXXPLXXQI

SEQ ID NO: 1684 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(5): Xaa = alpha-aminoisobutyric acid (Aib)
  MOD_RES (7)...(7): Xaa = isovaline (Iva)
  MOD_RES (9)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (0)...(0): optionally isoleucinol
XSAXXQXLXAXXPLXXQI

SEQ ID NO: 1685 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = optionally N-acetyl-alpha-aminoisobutyric acid (Ac-Aib) or alpha-aminoisobutyric acid (Aib)
  MOD_RES (5)...(5): Xaa = isovaline (Iva)
  MOD_RES (7)...(9): Xaa = optionally N-acetyl-alpha-aminoisobutyric acid (Ac-Aib) or alpha-aminoisobutyric acid (Aib)
  MOD_RES (11)...(11): Xaa = ispvaline (Iva)
  MOD_RES (12)...(16): Xaa = optionally N-acetyl-alpha-aminoisobutyric acid (Ac-Aib) or alpha-aminoisobutyric acid (Aib)
  MOD_RES (18)...(18): optionally leucinol
XSAXXQXLXAXXPLXXQI

SEQ ID NO: 1686 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(7): Xaa = isovaline (Iva)
  MOD_RES (9)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XSAXXQXLXAXXPLXXQL

SEQ ID NO: 1687 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(7): Xaa = isovaline (Iva)
  MOD_RES (9)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally isoleucinol
XSAXXQXLXAXXPLXXQI

SEQ ID NO: 1688 - protein, 20 aa, Trichoderma koningii
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXVXGLAPVXXQQF

SEQ ID NO: 1689 - protein, 20 aa, Trichoderma koningii
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = optionally N-acetyl-alpha-aminoisobutyric acid (Ac-Aib) or alpha-aminoisobutyric acid (Aib)
  MOD_RES (20)...(20): optionally phenylalaninol
XGXAXAQXVXGLXPVXXQQF

SEQ ID NO: 1690 - protein, 20 aa, Trichoderma koningii
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXAQXVXGLXPAXXQQF

SEQ ID NO: 1691 - protein, 20 aa, Trichoderma koningii
  MOD_RES (1)...(1): optionally N-acetyl-alanine
  MOD_RES (3)...(17): Xaa = alpha-aminoisobutyric acid (Aib)
  MOD_RES (20)...(20): optionally phenylalaninol
AAXAXAQXVXGLXPVXXQQF

SEQ ID NO: 1692 - protein, 20 aa, Trichoderma koningii
  MOD_RES (1)...(1): Xaa = optionally N-acetyl-alpha-aminoisobutyric acid (Ac-Aib) or alpha-aminoisobutyric acid (Aib)
  MOD_RES (5)...(17): Xaa = alpha-aminoisobutyric acid (Aib)
  MOD_RES (20)...(20): optionally phenylalaninol
XAAAXAQXVXGLXPVXXQQF

SEQ ID NO: 1693 - protein, 19 aa, Trichoderma koningii
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (19)...(19): optionally phenylalaninol
XAXAXQXVXGLXPVXXQQF

SEQ ID NO: 1694 - protein, 20 aa, Trichoderma koningii
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXVXGLXPVXXQQF

SEQ ID NO: 1695 - protein, 20 aa, Trichoderma koningii
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXXQXVXGLXPVXXQQF

SEQ ID NO: 1696 - protein, 20 aa, Trichoderma koningii
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (17)...(17): Xaa = isovaline (Iva)
  MOD_RES (20)...(20): optionally phenylalaninol
XAXAXAQXVXGLXPVXXQQF

SEQ ID NO: 1697 - protein, 19 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (4)...(16): Xaa = alpha-aminoisobutyric acid (Aib)
  MOD_RES (19)...(19): optionally leucinol
XGFXXQXXXSLXPVXXQQL

SEQ ID NO: 1698 - protein, 19 aa, Trichoderma longibrachiatum
  MOD_RES (1)...(1): Xaa = optionally N-acetyl-alpha-aminoisobutyric acid (Ac-Aib) or alpha-aminoisobutyric acid (Aib)
  MOD_RES (4)...(15): Xaa = alpha-aminoisobutyric acid (Aib)
  MOD_RES (16)...(16): Xaa = isovaline (Iva)
  MOD_RES (19)...(19): optionally leucinol
XGFXXQXXXSLXPVXXQQL

SEQ ID NO: 1699 - protein, 9 aa, Trichoderma polysporum
  MOD_RES (1)...(1): (2R)-methyldecanoyl-proline
  MOD_RES (2)...(2): Xaa = 2-amino-4-methyl-6-hydroxy-8-oxo-decanoic acid (AHMO, AHMOD)
  MOD_RES (4)...(8): Xaa = alpha-aminoisobutyric acid (Aib)
  MOD_RES (9)...(9): Xaa = alpha-aminoisobutyric acid (Aib) modified by 2-[(2'-aminopropyl)-methylamino]-ethanol (AMAE)
PXAXXIAXX

SEQ ID NO: 1700 - protein, 9 aa, Trichoderma polysporum
  MOD_RES (1)...(1): (2R)-methyldecanoyl-proline
  MOD_RES (2)...(2): Xaa = 2-amino-4-methyl-6-hydroxy-8-oxo-decanoic acid (AHMO, AHMOD)
  MOD_RES (4)...(8): Xaa = alpha-aminoisobutyric acid (Aib)
  MOD_RES (9)...(9): Xaa = alpha-aminoisobutyric acid (Aib) modified by 2-[(2'-aminopropyl)-methylamino]-ethanol (AMAE)
PXAXXVAXX

SEQ ID NO: 1701 - protein, 9 aa, Trichoderma polysporum
  MOD_RES (1)...(1): (2R)-methyldecanoyl-proline
  MOD_RES (2)...(2): Xaa = 2-amino-4-methyl-6-hydroxy-8-oxo-decanoic acid (AHMO, AHMOD)
  MOD_RES (4)...(8): Xaa = alpha-aminoisobutyric acid (Aib)
  MOD_RES (9)...(9): Ala modified by 2-[(2'-aminopropyl)-methylamino]-ethanol (AMAE)
PXAXXIAXA

SEQ ID NO: 1702 - protein, 9 aa, Trichoderma polysporum
  MOD_RES (1)...(1): (2R)-methyldecanoyl-proline
  MOD_RES (2)...(2): Xaa = 2-amino-4-methyl-6-hydroxy-8-oxo-decanoic acid (AHMO, AHMOD)
  MOD_RES (4)...(8): Xaa = alpha-aminoisobutyric acid (Aib)
  MOD_RES (9)...(9): Ala modified by 2-[(2'-aminopropyl)-methylamino]-ethanol (AMAE)
PXAXXVAXA

SEQ ID NO: 1703 - protein, 9 aa, Trichoderma polysporum
  MOD_RES (1)...(1): 3-hydroxy-2-methyldecanoyl-proline
  MOD_RES (2)...(2): Xaa = 2-amino-4-methyl-6-hydroxy-8-oxo-decanoic acid (AHMO, AHMOD)
  MOD_RES (4)...(8): Xaa = alpha-aminoisobutyric acid (Aib)
  MOD_RES (9)...(9): Xaa = alpha-aminoisobutyric acid (Aib) modified by 2-[(2'-aminopropyl)-methylamino]-ethanol (AMAE)
PXAXXIAXX

SEQ ID NO: 1704 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (4)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): optionally valinol
XNVXXPXXXPV

SEQ ID NO: 1705 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XNVVXPXXXPX

SEQ ID NO: 1706 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XNVVXPXXXPX

SEQ ID NO: 1707 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(3): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): optionally valinol
XNXVXPXXXPV

SEQ ID NO: 1708 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XQVVXPXXXPX

SEQ ID NO: 1709 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (4)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): optionally valinol
XQVXXPXXXPV

SEQ ID NO: 1710 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XQVVXPXXXPX

SEQ ID NO: 1711 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(3): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): optionally valinol
XQXVXPXXXPV

SEQ ID NO: 1712 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (4)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XNVXXPXXXPX

SEQ ID NO: 1713 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (4)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XQVXXPXXXPX

SEQ ID NO: 1714 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): optionally valinol
XQXXXPXXXPV

SEQ ID NO: 1715 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (4)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XNVXXPXXXPX

SEQ ID NO: 1716 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): optionally valinol
XNXXXPXXXPV

SEQ ID NO: 1717 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (4)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XNVXXPXXXPX

SEQ ID NO: 1718 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): optionally valinol
XNXXXPXXXPV

SEQ ID NO: 1719 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(3): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): Xaa = optionally Leu, Ile, leucinol or isoleucinol
XNXVXPXXXPX

SEQ ID NO: 1720 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (4)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): optionally valinol
XQVXXPXXXPV

SEQ ID NO: 1721 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (4)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XQVXXPXXXPX

SEQ ID NO: 1722 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(3): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XQXVXPXXXPX

SEQ ID NO: 1723 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XNXXXPXXXPX

SEQ ID NO: 1724 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally isoleucinol
XNIIXPLLXPI

SEQ ID NO: 1725 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  MOD_RES (11)...(11): optionally leucinol
XNXXXPXXXPL

SEQ ID NO: 1726 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XQXXXPXXXPX

SEQ ID NO: 1727 - protein, 11 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (3)...(4): Xaa = Leu or Ile (Lx)
  MOD_RES (5)...(5): Xaa = alpha-aminoisobutyric acid (Aib)
  VARIANT (7)...(8): Xaa = Leu or Ile (Lx)
  MOD_RES (9)...(9): Xaa = alpha-aminoisobutyric acid (Aib)
  VARIANT (11)...(11): Xaa = optionally Leu, Ile, leucinol or isoleucinol
XQXXXPXXXPX

SEQ ID NO: 1728 - protein, 11 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally valinol
XNILXPILXPV

SEQ ID NO: 1729 - protein, 11 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally valinol
XQILXPILXPV

SEQ ID NO: 1730 - protein, 11 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally leucinol
XNILXPILXPL

SEQ ID NO: 1731 - protein, 11 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): optionally leucinol
XQILXPILXPL

SEQ ID NO: 1732 - protein, 19 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(15): Xaa = alpha-aminoisobutyric acid (Aib)
  MOD_RES (19)...(19): optionally tryptophanol
XAAXXQXXXSLXPVXIQQW

SEQ ID NO: 1733 - protein, 19 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(15): Xaa = alpha-aminoisobutyric acid (Aib)
  MOD_RES (19)...(19): optionally tryptophanol
XAAXXQXXXSLXPLXIQEW

SEQ ID NO: 1734 - protein, 19 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(15): Xaa = alpha-aminoisobutyric acid (Aib)
  MOD_RES (19)...(19): optionally tryptophanol
XAAXXQXXXSLXPVXIQEW

SEQ ID NO: 1735 - protein, 19 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(15): Xaa = alpha-aminoisobutyric acid (Aib)
  MOD_RES (19)...(19): optionally tryptophanol
XAAXXQXXXSLXPVXIQEW

SEQ ID NO: 1736 - protein, 19 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(15): Xaa = alpha-aminoisobutyric acid (Aib)
  MOD_RES (19)...(19): optionally phenylalaninol
XAAXXQXXXSLXPLXIQEF

SEQ ID NO: 1737 - protein, 19 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(15): Xaa = alpha-aminoisobutyric acid (Aib)
  MOD_RES (19)...(19): optionally phenylalaninol
XAAXXQXXXSLXPLXIQEF

SEQ ID NO: 1738 - protein, 19 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(15): Xaa = alpha-aminoisobutyric acid (Aib)
  MOD_RES (19)...(19): optionally phenylalaninol
XAAXXQXXXSLXPVXIQEF

SEQ ID NO: 1739 - protein, 19 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(15): Xaa = alpha-aminoisobutyric acid (Aib)
  MOD_RES (19)...(19): optionally phenylalaninol
XAAXXQXXXSLXPVXIQEF

SEQ ID NO: 1740 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(16): Xaa = alpha-aminoisobutyric acid (Aib)
  MOD_RES (18)...(18): optionally leucinol
XGAXXQXVXGLXPLXXQL

SEQ ID NO: 1741 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(15): Xaa = alpha-aminoisobutyric acid (Aib)
  MOD_RES (16)...(16): Xaa = isovaline (Iva)
  MOD_RES (18)...(18): optionally leucinol
XGAXXQXVXGLXPLXXQL

SEQ ID NO: 1742 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = optionally N-acetyl-alpha-aminoisobutyric acid (Ac-Aib) or alpha-aminoisobutyric acid (Aib)
  MOD_RES (5)...(5): Xaa = isovaline (Iva)
  MOD_RES (7)...(15): Xaa = alpha-aminoisobutyric acid (Aib)
  MOD_RES (18)...(18): optionally leucinol
XGAXXQXVXGLXPLXXQL

SEQ ID NO: 1743 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(15): Xaa = alpha-aminoisobutyric acid (Aib)
  MOD_RES (16)...(16): Xaa = isovaline (Iva)
  MOD_RES (18)...(18): optionally leucinol
XGAXXQXVXGLXPLXXQL

SEQ ID NO: 1744 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(7): Xaa = isovaline (Iva)
  MOD_RES (9)...(15): Xaa = alpha-aminoisobutyric acid (Aib)
  MOD_RES (16)...(16): Xaa = isovaline (Iva)
  MOD_RES (18)...(18): optionally leucinol
XGAXXQXVXGLXPLXXQL

SEQ ID NO: 1745 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (9)...(15): Xaa = alpha-aminoisobutyric acid (Aib)
  MOD_RES (16)...(16): Xaa = isovaline (Iva)
  MOD_RES (18)...(18): optionally leucinol
XGAXXQVVXGLXPLXXQL

SEQ ID NO: 1746 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(16): Xaa = alpha-aminoisobutyric acid (Aib)
  MOD_RES (18)...(18): optionally valinol
XSAXXQXLXGLXPLXXQV

SEQ ID NO: 1747 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(16): Xaa = alpha-aminoisobutyric acid (Aib)
  MOD_RES (18)...(18): optionally valinol
XSAXXQXLXGLXPLXXQV

SEQ ID NO: 1748 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(7): Xaa = isovaline (Iva)
  MOD_RES (9)...(16): Xaa = alpha-aminoisobutyric acid (Aib)
  MOD_RES (18)...(18): optionally valinol
XSAXXQXLXGLXPLXXQV

SEQ ID NO: 1749 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(16): Xaa = optionally N-acetyl-alpha-aminoisobutyric acid (Ac-Aib) or alpha-aminoisobutyric acid (Aib)
  MOD_RES (18)...(18): optionally tryptophanol
XSAXXQXVXGLXPLXXQW

SEQ ID NO: 1750 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(7): Xaa = isovaline (Iva)
  MOD_RES (9)...(16): Xaa = alpha-aminoisobutyric acid (Aib)
  MOD_RES (18)...(18): optionally tryptophanol
XSAXXQXVXGLXPLXXQW

SEQ ID NO: 1751 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(5): Xaa = isovaline (Iva)
  MOD_RES (7)...(16): Xaa = alpha-aminoisobutyric acid (Aib)
  MOD_RES (18)...(18): optionally tryptophanol
XSAXXQXVXGLXPLXXQW

SEQ ID NO: 1752 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = alpha-aminoisobutyric acid (Aib)
  MOD_RES (5)...(5): Xaa = isovaline (Iva)
  MOD_RES (7)...(16): Xaa = alpha-aminoisobutyric acid (Aib)
  MOD_RES (18)...(18): optionally phenylalaninol
XSAXXQXVXGLXPLXXQF

SEQ ID NO: 1753 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(5): Xaa = isovaline (Iva)
  MOD_RES (7)...(16): Xaa = alpha-aminoisobutyric acid (Aib)
  MOD_RES (18)...(18): optionally tryptophanol
XSAXXQXVXGLXPLXXQW

SEQ ID NO: 1754 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(4): Xaa = optionally N-acetyl-alpha-aminoisobutyric acid (Ac-Aib) or alpha-aminoisobutyric acid (Aib)
  MOD_RES (5)...(7): Xaa = isovaline (Iva)
  MOD_RES (9)...(16): Xaa = alpha-aminoisobutyric acid (Aib)
  MOD_RES (18)...(18): optionally phenylalaninol
XSAXXQXVXGLXPLXXQF

SEQ ID NO: 1755 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(5): aa = isovaline (Iva)
  MOD_RES (7)...(16): Xaa = alpha-aminoisobutyric acid (Aib)
  MOD_RES (18)...(18): optionally phenylalaninol
XSAXXQXVXGLXPLXXQF

SEQ ID NO: 1756 - protein, 18 aa, Trichoderma harzianum
  MOD_RES (1)...(1): Xaa = optionally N-acetyl-alpha-aminoisobutyric acid (Ac-Aib) or alpha-aminoisobutyric acid (Aib)
  MOD_RES (4)...(16): Xaa = alpha-aminoisobutyric acid (Aib)
  MOD_RES (18)...(18): optionally tryptophanol
XSAXXQXVXGLXPLXXQW

SEQ ID NO: 1757 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (4)...(8): Xaa = alpha-aminoisobutyric acid (Aib)
  VARIANT (9)...(9): Xaa = Leu or Ile (Lx)
  VARIANT (12)...(12): Xaa = Val or isovaline (Iva) (Vx)
  MOD_RES (16)...(16): Xaa = alpha-aminoisobutyric acid (Aib)
  VARIANT (17)...(17): Xaa = Val or isovaline (Iva) (Vx)
  MOD_RES (20)...(20): optionally phenylalaninol
XAGXAXQXXAAXAPVXXQQF

SEQ ID NO: 1758 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  VARIANT (9)...(9): Xaa = Leu or Ile (Lx)
  VARIANT (12)...(12): Xaa = Val or isovaline (Iva) (Vx)
  MOD_RES (16)...(16): Xaa = alpha-aminoisobutyric acid (Aib)
  VARIANT (17)...(17): Xaa = Val or isovaline (Iva) (Vx)
  MOD_RES (20)...(20): optionally phenylalaninol
XAGAXXQXXAAXAPVXXQQF

SEQ ID NO: 1759 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  VARIANT (9)...(9): Xaa = Leu or Ile (Lx)
  MOD_RES (10)...(10): Xaa = alpha-aminoisobutyric acid (Aib)
  VARIANT (12)...(12): Xaa = Leu or Ile (Lx)
  MOD_RES (16)...(16): Xaa = alpha-aminoisobutyric acid (Aib)
  MOD_RES (20)...(20): optionally phenylalaninol
XAGAXXQXXXGXAPVXAQQF

SEQ ID NO: 1760 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  VARIANT (9)...(9): Xaa = Leu or Ile (Lx)
  MOD_RES (10)...(10): Xaa = alpha-aminoisobutyric acid (Aib)
  VARIANT (12)...(12): Xaa = Leu or Ile (Lx)
  MOD_RES (16)...(17): Xaa = alpha-aminoisobutyric acid (Aib)
  MOD_RES (20)...(20): optionally phenylalaninol
XASAXXQXXXGXAPVXXQQF

SEQ ID NO: 1761 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  VARIANT (9)...(9): Xaa = Leu or Ile (Lx)
  MOD_RES (10)...(10): Xaa = alpha-aminoisobutyric acid (Aib)
  VARIANT (12)...(12): Xaa = Leu or Ile (Lx)
  MOD_RES (13)...(17): Xaa = alpha-aminoisobutyric acid (Aib)
  MOD_RES (20)...(20): optionally phenlalaninol
XAGAXXQXXXGXXPVXXQQF

SEQ ID NO: 1762 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  VARIANT (9)...(9): Xaa = Leu or Ile (Lx)
  MOD_RES (10)...(10): Xaa = alpha-aminoisobutyric acid (Aib)
  VARIANT (12)...(12): Xaa = Leu or Ile (Lx)
  MOD_RES (13)...(17): Xaa = alpha-aminoisobutyric acid (Aib)
  MOD_RES (20)...(20): optionally phenylalaninol
XASAXXQXXXGXXPVXXQQF

SEQ ID NO: 1763 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  VARIANT (9)...(9): Xaa = Leu or Ile (Lx)
  MOD_RES (10)...(10): Xaa = alpha-aminoisobutyric acid (Aib)
  VARIANT (12)...(12): Xaa = Leu or Ile (Lx)
  MOD_RES (16)...(17): Xaa = alpha-aminoisobutyric acid (Aib)
  MOD_RES (20)...(20): optionally phenylalaninol
XAGAXXQXXXGXAPVXXQQF

SEQ ID NO: 1764 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(8): Xaa = alpha-aminoisobutyric acid (Aib)
  VARIANT (9)...(9): Xaa = Leu or Ile (Lx)
  MOD_RES (10)...(10): Xaa = alpha-aminoisobutyric acid (Aib)
  VARIANT (12)...(12): Xaa = Leu or Ile (Lx)
  MOD_RES (13)...(16): Xaa = alpha-aminoisobutyric acid (Aib)
  VARIANT (17)...(17): Xaa = Val or isovaline (Iva) (Vx)
  MOD_RES (20)...(20): optionally phenylalaninol
XAGAXXQXXXGXXPVXXQQF

SEQ ID NO: 1765 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(17): Xaa = alpha-aminoisobutyric acid (Aib)
  MOD_RES (20)...(20): optionally phenylalaninol
XASAXXQXLXGLXPVXXQQF

SEQ ID NO: 1766 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(17): Xaa = alpha-aminoisobutyric acid (Aib)
  MOD_RES (20)...(20): optionally phenylalaninol
XAAAXXQXLXGLXPVXXQQF

SEQ ID NO: 1767 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(16): Xaa = alpha-aminoisobutyric acid (Aib)
  MOD_RES (20)...(20): optionally phenylalaninol
XAAAXXQXIXGLXPVXAQQF

SEQ ID NO: 1768 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (6)...(17): Xaa = alpha-aminoisobutyric acid (Aib)
  MOD_RES (20)...(20): optionally phenylalaninol
XAAAAXQXIXGLXPVXXQQF

SEQ ID NO: 1769 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(17): Xaa = alpha-aminoisobutyric acid (Aib)
  MOD_RES (20)...(20): optionally phenylalaninol
XAAAXXQXVXGLXPVXXQQF

SEQ ID NO: 1770 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(16): Xaa = alpha-aminoisobutyric acid (Aib)
  MOD_RES (17)...(17): Xaa = isovaline (Iva)
  MOD_RES (20)...(20): optionally phenylalaninol
XAAAXXQXLXGLXPVXXQQF

SEQ ID NO: 1771 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXXQXVXGLXPVXXQQF

SEQ ID NO: 1772 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(16): Xaa = alpha-aminoisobutyric acid (Aib)
  MOD_RES (17)...(17): Xaa = isovaline (Iva)
  MOD_RES (20)...(20): optionally phenylalaninol
XAAAXXQXVXGLXPVXXQQF

SEQ ID NO: 1773 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(17): Xaa = alpha-aminoisobutyric acid (Aib)
  MOD_RES (20)...(20): optionally phenylalaninol
XAAAXXQXIXGLXPVXXQQF

SEQ ID NO: 1774 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (3)...(17): Xaa = alpha-aminoisobutyric acid (Aib)
  MOD_RES (20)...(20): optionally phenylalaninol
XAXAXXQXIXGLXPVXXQQF

SEQ ID NO: 1775 - protein, 20 aa, Trichoderma polysporum
  MOD_RES (1)...(1): Xaa = optionally N-acetyl-alpha-aminoisobutyric acid (Ac-Aib) or alpha-aminoisobutyric acid (Aib)
  MOD_RES (5)...(16): Xaa = alpha-aminoisobutyric acid (Aib)
  MOD_RES (17)...(17): Xaa = isovaline (Iva)
  MOD_RES (20)...(20): optionally phenylalninol
XAAAXXQXIXGLXPVXXQQF

SEQ ID NO: 1776 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(15): Xaa = alpha-aminoisobutyric acid (Aib)
  MOD_RES (16)...(16): Xaa = isovaline (Iva)
  MOD_RES (18)...(18): optionally valinol
XGXLXEXXXAXXPLXXQV

SEQ ID NO: 1777 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (18)...(18): optionally valinol
XGXLXQXXAAXXPLXXEV

SEQ ID NO: 1778 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (18)...(18): optionally valinol
XGXLXQXXXAAXPLXXEV

SEQ ID NO: 1779 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(15): Xaa = alpha-aminoisobutyric acid (Aib)
  MOD_RES (16)...(16): Xaa = isovaline (Iva)
  MOD_RES (18)...(18): optionally valinol
XGXLXQXXAAXXPLXXEV

SEQ ID NO: 1780 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (18)...(18): optionally valinol
XGXLXQXXXAXXPLXXEV

SEQ ID NO: 1781 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(15): Xaa = alpha-aminoisobutyric acid (Aib)
  MOD_RES (16)...(16): Xaa = isovaline (Iva)
  MOD_RES (18)...(18): optionally valinol
XGXLXQXXXAXXPLXXEV

SEQ ID NO: 1782 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (18)...(18): optionally valinol
XAXLXQXXXAXXPLXXEV

SEQ ID NO: 1783 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(16): Xaa = alpha-aminoisobutyric acid (Aib)
  MOD_RES (18)...(18): optionally valinol
XGXLXQXXXAAXPLXXQV

SEQ ID NO: 1784 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(15): Xaa = alpha-aminoisobutyric acid (Aib)
  MOD_RES (16)...(16): Xaa = isovaline (Iva)
  MOD_RES (18)...(18): optionally valinol
XGXLXQXXAAAXPLXXQV

SEQ ID NO: 1785 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(15): Xaa = alpha-aminoisobutyric acid (Aib)
  MOD_RES (16)...(16): Xaa = isovaline (Iva)
  MOD_RES (18)...(18): optionally valinol
XGXLXQXXXAAXPLXXQV

SEQ ID NO: 1786 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(15): Xaa = alpha-aminoisobutyric acid (Aib)
  MOD_RES (16)...(16): Xaa = isovaline (Iva)
  MOD_RES (18)...(18): optionally valinol
XAXLXQXXXAAXPLXXQV

SEQ ID NO: 1787 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(15): Xaa = alpha-aminoisobutyric acid (Aib)
  MOD_RES (16)...(16): Xaa = isovaline (Iva)
  MOD_RES (18)...(18): optionally valinol
XGXLXQXXXAXXPLXXQV

SEQ ID NO: 1788 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (3)...(15): Xaa = alpha-aminoisobutyric acid (Aib)
  MOD_RES (16)...(16): Xaa = isovaline (Iva)
  MOD_RES (18)...(18): optionally valinol
XAXLXQXXXAXXPLXXQV

SEQ ID NO: 1789 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  VARIANT (7)...(7): Xaa = Val or isovaline (Iva) (Vx)
  MOD_RES (9)...(16): Xaa = alpha-aminoisobutyric acid (Aib)
  MOD_RES (18)...(18): optionally leucinol
XGALAQXVXGXXPLXXQL

SEQ ID NO: 1790 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XGALXQAVXGXXPLXXQL

SEQ ID NO: 1791 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (7)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XGALAQXVXGXXPLXXQL

SEQ ID NO: 1792 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(16): Xaa = alpha-aminoisobutyric acid (Aib)
  MOD_RES (18)...(18): optionally leucinol
XGALXQXVXGXXPLXXQL

SEQ ID NO: 1793 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  VARIANT (7)...(7): Xaa = Val or isovaline (Iva) (Vx)
  MOD_RES (9)...(16): Xaa = alpha-aminoisobutyric acid (Aib)
  MOD_RES (18)...(18): optionally leucinol
XGALXQXVXGXXPLXXQL

SEQ ID NO: 1794 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  MOD_RES (7)...(7): Xaa = isovaline (Iva)
  MOD_RES (9)...(16): Xaa = alpha-aminoisobutyric acid (Aib)
  MOD_RES (18)...(18): optionally leucinol
XGALXQXVXGXXPLXXQL

SEQ ID NO: 1795 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(7): Xaa = isovaline (Iva)
  MOD_RES (8)...(16): Xaa = alpha-aminoisobutyric acid (Aib)
  MOD_RES (18)...(18): optionally leucinol
XGALXQXXXGXXPLXXQL

SEQ ID NO: 1796 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(7): Xaa = isovaline (Iva)
  MOD_RES (9)...(16): Xaa = alpha-aminoisobutyric acid (Aib)
  MOD_RES (18)...(18): optionally leucinol
XGALXQXVXGXXPLXXQL

SEQ ID NO: 1797 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XGALXQXVXGXXPLXXQL

SEQ ID NO: 1798 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  MOD_RES (7)...(7): Xaa = isovaline (Iva)
  MOD_RES (9)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XGALXQXVXGXXPLXXQL

SEQ ID NO: 1799 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(5): Xaa = alpha-aminoisobutyric acid (Aib)
  MOD_RES (7)...(7): Xaa = isovaline (va)
  MOD_RES (9)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XGALXQXLXGXXPLXXQL

SEQ ID NO: 1800 - protein, 18 aa, Trichoderma viride
  MOD_RES (1)...(1): Xaa = optionally N-acetyl-alpha-aminoisobutyric acid (Ac-Aib) or alpha-aminoisobutyric acid (Aib)
  MOD_RES (5)...(7): Xaa = isovaline (Iva)
  MOD_RES (9)...(9): Xaa = alpha-aminoisobutyric acid (Aib)
  MOD_RES (11)...(11): Xaa = isovaline (Iva)
  MOD_RES (12)...(16): Xaa = alpha-aminoisobutyric acid (Aib)
  MOD_RES (18)...(18): optionally leucinol
XGALXQXVXGXXPLXXQL

SEQ ID NO: 1801 - protein, 19 aa, Trichoderma koningii
  MOD_RES (1)...(1): Xaa = optionally N-acetyl-alpha-aminoisobutyric acid (Ac-Aib) or alpha-aminoisobutyric acid (Aib)
  MOD_RES (4)...(15): Xaa = alpha-aminoisobutyric acid (Aib)
  MOD_RES (19)...(19): optionally leucinol
XGAXIQXXXSLXPVXIQQL

SEQ ID NO: 1802 - protein, 11 aa, Trichoderma koningii
  MOD_RES (1)...(1): Xaa = optionally N-octyl-alpha-aminoisobutyric acid (Oc-Aib) or alpha-aminoisobutyric acid (Aib)
  MOD_RES (4)...(8): Xaa = alpha-aminoisobutyric acid (Aib)
  MOD_RES (11)...(11): optionally leucinol
XGVXGGVXGIL

SEQ ID NO: 1803 - protein, 11 aa, Trichoderma koningii
  MOD_RES (1)...(1): Xaa = optionally N-octyl-isovaline (Oc-Iva) or isovaline (Iva)
  MOD_RES (4)...(8): Xaa = alpha-aminoisobutyric acid (Aib)
  MOD_RES (11)...(11): optionally leucinol
XGVXGGVXGIL

SEQ ID NO: 1804 - protein, 15 aa, Tylopilus neofelleus
  MOD_RES (1)...(1): optionally N-acetyl-tryptophan (Ac-Trp)
  MOD_RES (3)...(3): Xaa = alpha-aminoisobutyric acid (Aib)
  MOD_RES (4)...(4): Xaa = isovaline (Iva)
  MOD_RES (8)...(13): Xaa = alpha-aminoisobutyric acid (Aib)
  MOD_RES (15)...(15): optionally leucinol
WVXXAQAXSXALXQL

SEQ ID NO: 1805 - protein, 15 aa, Tylopilus neofelleus
  MOD_RES (1)...(1): optionally N-acetyl-tryptophan (Ac-Trp)
  MOD_RES (3)...(13): Xaa = alpha-aminoisobutyric acid (Aib)
  MOD_RES (15)...(15): optionally leucinol
WVXXAQAXSXALXQL

SEQ ID NO: 1806 - protein, 17 aa, Acremonium persicinum
  MOD_RES (1)...(1): optionally N-acetyl-tryptophan (Ac-Trp)
  MOD_RES (2)...(2): Xaa = isovaline (Iva)
  MOD_RES (4)...(12): Xaa = alpha-aminoisobutyric acid (Aib)
  MOD_RES (13)...(13): Xaa = hydroxyproline (Hyp)
  MOD_RES (14)...(14): Xaa = isovaline (Iva)
  MOD_RES (17)...(17): optionally glycinol
WXQXITXLXPQXXXPFG

SEQ ID NO: 1807 - protein, 16 aa, Artificial Sequence
  synthetic zervamicin-A1-16, apolar peptaibol related to alamethicin
  MOD_RES (1)...(1): optionally N-((1,1-dimethylethoxy)carbonyl)-tryptophan (Boc-Trp)
  MOD_RES (4)...(14): Xaa = alpha-aminoisobutyric acid (Aib)
  MOD_RES (16)...(16): optionally phenylalanine methyl ester
WIAXIVXLXPAXPXPF

SEQ ID NO: 1808 - protein, 16 aa, Emericellopsis salmosynnemata
  MOD_RES (1)...(1): optionally N-acetyl-tryptophan (Ac-Trp)
  MOD_RES (4)...(4): Xaa = isovaline (Iva)
  MOD_RES (7)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIEXVTXLXXQXXXPF

SEQ ID NO: 1809 - protein, 16 aa, Emericellopsis salmosynnemata
  MOD_RES (1)...(1): optionally N-acetyl-tryptophan (Ac-Trp)
  MOD_RES (4)...(4): Xaa = isovaline (Iva)
  MOD_RES (7)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WVEXITXLXXQXXXPF

SEQ ID NO: 1810 - protein, 16 aa, Emericellopsis salmosynnemata
  MOD_RES (1)...(1): optionally N-acetyl-tryptophan (Ac-Trp)
  MOD_RES (4)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIEXITXLXXQXXXPF

SEQ ID NO: 1811 - protein, 16 aa, Emericellopsis salmosynnemata
  MOD_RES (1)...(1): optionally N-acetyl-tryptophan (Ac-Trp)
  MOD_RES (4)...(4): Xaa = isovaline (Iva)
  MOD_RES (7)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIEXITXLXXQXXXPF

SEQ ID NO: 1812 - protein, 16 aa, Emericellopsis salmosynnemata
  MOD_RES (1)...(1): optionally N-acetyl-tryptophan (Ac-Trp)
  MOD_RES (4)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIQXVTXLXXQXXXPF

SEQ ID NO: 1813 - protein, 16 aa, Emericellopsis salmosynnemata
  MOD_RES (1)...(1): optionally N-acetyl-tryptophan (Ac-Trp)
  MOD_RES (4)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIQXITXVXXQXXXPF

SEQ ID NO: 1814 - protein, 16 aa, Emericellopsis salmosynnemata
  MOD_RES (1)...(1): optionally N-acetyl-tryptophan (Ac-Trp)
  MOD_RES (4)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WVQXITXLXXQXXXPF

SEQ ID NO: 1815 - protein, 16 aa, Emericellopsis salmosynnemata
  MOD_RES (1)...(1): optionally N-acetyl-tryptophan (Ac-Trp)
  MOD_RES (4)...(4): Xaa = isovaline (Iva)
  MOD_RES (7)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIQXVTXLXXQXXXPF

SEQ ID NO: 1816 - protein, 16 aa, Emericellopsis salmosynnemata
  MOD_RES (1)...(1): optionally N-acetyl-tryptophan (Ac-Trp)
  MOD_RES (4)...(4): Xaa = isovaline (Iva)
  MOD_RES (7)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIQXITXVXXQXXXPF

SEQ ID NO: 1817 - protein, 16 aa, Emericellopsis salmosynnemata
  MOD_RES (1)...(1): optionally N-acetyl-tryptophan (Ac-Trp)
  MOD_RES (4)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIQXITXLXXQXXXPF

SEQ ID NO: 1818 - protein, 16 aa, Emericellopsis salmosynnemata
  MOD_RES (1)...(1): optionally N-acetyl-tryptophan (Ac-Trp)
  MOD_RES (4)...(4): Xaa = isovaline (Iva)
  MOD_RES (7)...(9): Xaa = alpha-aminoisobutyric acid (Aib)
  MOD_RES (10)...(10): Xaa = hydroxyproline (Hyp)
  MOD_RES (12)...(12): Xaa = alpha-aminoisobutyric acid (Aib)
  MOD_RES (13)...(13): Xaa = hydroxyproline (Hyp)
  MOD_RES (14)...(14): Xaa = alpha-aminoisobutyric acid (Aib)
  MOD_RES (16)...(16): optionally phenylalaninol
WIQXITXLXXQXXXPF

SEQ ID NO: 1819 - protein, 15 aa, Artificial Sequence
  synthetic cecropin-melittin hybrid peptide (CAMEL0, CA(1-7)M(2-9)NH2) analog CAMEL135
GWRLIKKILRVFKGL

SEQ ID NO: 1820 - protein, 16 aa, Artificial Sequence
  synthetic novispirin G2 analog, specifically targeted antimicrobial peptide (STAMP) fusion peptide of Streptococcus mutans pheromone competence stimulating peptide (CSP) targeting peptide domain and antimicrobial peptide novispirin G10
  AMIDATION (16)...(16): tyrosinamide
KNLRIIRKGIHIIKKY

SEQ ID NO: 1821 - protein, 11 aa, Artificial Sequence
  synthetic antimicrobial peptide B-33 (S6L3-33)
FKKFWKWFRRF

SEQ ID NO: 1822 - protein, 11 aa, Artificial Sequence
  synthetic antimicrobial peptide B-34
LKRFLKWFKRF

SEQ ID NO: 1823 - protein, 11 aa, Artificial Sequence
  synthetic antimicrobial peptide B-35
KLFKRWKHLFR

SEQ ID NO: 1824 - protein, 11 aa, Artificial Sequence
  synthetic antimicrobial peptide B-36
RLLKRFKHLFK

SEQ ID NO: 1825 - protein, 11 aa, Artificial Sequence
  synthetic antimicrobial peptide B-37
FKTFLKWLHRF

SEQ ID NO: 1826 - protein, 11 aa, Artificial Sequence
  synthetic antimicrobial peptide B-38
IKQLLHFFQRF

SEQ ID NO: 1827 - protein, 11 aa, Artificial Sequence
  synthetic antimicrobial peptide B-39
KLLQTFKQIFR

SEQ ID NO: 1828 - protein, 11 aa, Artificial Sequence
  synthetic antimicrobial peptide B-40
RILKELKNLFK

SEQ ID NO: 1829 - protein, 11 aa, Artificial Sequence
  synthetic antimicrobial peptide B-41
LKQFVHFIHRF

SEQ ID NO: 1830 - protein, 11 aa, Artificial Sequence
  synthetic antimicrobial peptide B-42
VKTLLHIFQRF

SEQ ID NO: 1831 - protein, 11 aa, Artificial Sequence
  synthetic antimicrobial peptide B-43
KLVEQLKEIFR

SEQ ID NO: 1832 - protein, 11 aa, Artificial Sequence
  synthetic antimicrobial peptide B-44
RVLQEIKQILK

SEQ ID NO: 1833 - protein, 11 aa, Artificial Sequence
  synthetic antimicrobial peptide B-45
VKNLAELVHRF

SEQ ID NO: 1834 - protein, 11 aa, Artificial Sequence
  synthetic antimicrobial peptide B-46
ATHLLHALQRF

SEQ ID NO: 1835 - protein, 11 aa, Artificial Sequence
  synthetic antimicrobial peptide B-47
KLAENVKEILR

SEQ ID NO: 1836 - protein, 11 aa, Artificial Sequence
  synthetic antimicrobial peptide B-48
RALHEAKEALK

SEQ ID NO: 1837 - protein, 11 aa, Artificial Sequence
  synthetic antimicrobial peptide B-49
FHYFWHWFHRF

SEQ ID NO: 1838 - protein, 11 aa, Artificial Sequence
  synthetic antimicrobial peptide B-50
LYHFLHWFQRF

SEQ ID NO: 1839 - protein, 11 aa, Artificial Sequence
  synthetic antimicrobial peptide B-51
YLFQTWQHLFR

SEQ ID NO: 1840 - protein, 11 aa, Artificial Sequence
  synthetic antimicrobial peptide B-52
YLLTEFQHLFK

SEQ ID NO: 1841 - protein, 11 aa, Artificial Sequence
  synthetic antimicrobial peptide B-53
FKTFLQWLHRF

SEQ ID NO: 1842 - protein, 11 aa, Artificial Sequence
  synthetic antimicrobial peptide B-54
IKTLLHFFQRF

SEQ ID NO: 1843 - protein, 11 aa, Artificial Sequence
  synthetic antimicrobial peptide B-55
KLLQTFNQIFR

SEQ ID NO: 1844 - protein, 11 aa, Artificial Sequence
  synthetic antimicrobial peptide B-56
TILQSLKNIFK

SEQ ID NO: 1845 - protein, 11 aa, Artificial Sequence
  synthetic antimicrobial peptide B-57
LKQFVKFIHRF

SEQ ID NO: 1846 - protein, 11 aa, Artificial Sequence
  synthetic antimicrobial peptide B-58
VKQLLKIFNRF

SEQ ID NO: 1847 - protein, 11 aa, Artificial Sequence
  synthetic antimicrobial peptide B-59
KLVQQLKNIFR

SEQ ID NO: 1848 - protein, 11 aa, Artificial Sequence
  synthetic antimicrobial peptide B-60
RVLNQVKQILK

SEQ ID NO: 1849 - protein, 11 aa, Artificial Sequence
  synthetic antimicrobial peptide B-61
VKKLAKLVRRF

SEQ ID NO: 1850 - protein, 11 aa, Artificial Sequence
  synthetic antimicrobial peptide B-62
AKRLLKVLKRF

SEQ ID NO: 1851 - protein, 11 aa, Artificial Sequence
  synthetic antimicrobial peptide B-63
KLAQKVKRVLR

SEQ ID NO: 1852 - protein, 11 aa, Artificial Sequence
  synthetic antimicrobial peptide B-64
RALKRIKHVLK

SEQ ID NO: 1853 - protein, 7 aa, Artificial Sequence
  synthetic antimicrobial peptide 1C-1
RRRRWWW

SEQ ID NO: 1854 - protein, 7 aa, Artificial Sequence
  synthetic antimicrobial peptide 1C-2
RRWWRRW

SEQ ID NO: 1855 - protein, 7 aa, Artificial Sequence
  synthetic antimicrobial peptide 1C-3
RRRWWWR

SEQ ID NO: 1856 - protein, 7 aa, Artificial Sequence
  synthetic antimicrobial peptide 1C-4
RWRWRWR

SEQ ID NO: 1857 - protein, 7 aa, Artificial Sequence
  synthetic antimicrobial peptide 2C-1
RRRFWWR

SEQ ID NO: 1858 - protein, 7 aa, Artificial Sequence
  synthetic antimicrobial peptide 2C-2
  AMIDATION (7)...(7): phenylalaninamide
RRWWRRF

SEQ ID NO: 1859 - protein, 7 aa, Artificial Sequence
  synthetic antimicrobial peptide 2C-3
  AMIDATION (7)...(7): phenylalaninamide
RRRWWWF

SEQ ID NO: 1860 - protein, 7 aa, Artificial Sequence
  synthetic antimicrobial peptide 2C-4
  AMIDATION (7)...(7): phenylalaninamide
RWRWRWF

SEQ ID NO: 1861 - protein, 7 aa, Artificial Sequence
  synthetic antimicrobial peptide 3C-1
RRRRWWK

SEQ ID NO: 1862 - protein, 7 aa, Artificial Sequence
  synthetic antimicrobial peptide 3C-2
RRWWRRK

SEQ ID NO: 1863 - protein, 7 aa, Artificial Sequence
  synthetic antimicrobial peptide 3C-3
RRRWWWK

SEQ ID NO: 1864 - protein, 7 aa, Artificial Sequence
  synthetic antimicrobial peptide 3C-4
RWRWRWK

SEQ ID NO: 1865 - protein, 7 aa, Artificial Sequence
  synthetic antimicrobial peptide 4C-1
RRRKWWK

SEQ ID NO: 1866 - protein, 7 aa, Artificial Sequence
  synthetic antimicrobial peptide 4C-2
RRWKRRK

SEQ ID NO: 1867 - protein, 7 aa, Artificial Sequence
  synthetic antimicrobial peptide 4C-3
RRRKWWK

SEQ ID NO: 1868 - protein, 7 aa, Artificial Sequence
  synthetic antimicrobial peptide 4C-4
RWRKRWK

SEQ ID NO: 1869 - protein, 14 aa, Artificial Sequence
  synthetic antimicrobial peptide alpha-3
  AMIDATION (14)...(14): phenylalaninamide
LHLLHQLLHLLHQF

SEQ ID NO: 1870 - protein, 14 aa, Artificial Sequence
  synthetic antimicrobial peptide alpha-4
  AMIDATION (14)...(14): phenylalaninamide
AQAAHQAAHAAHQF

SEQ ID NO: 1871 - protein, 14 aa, Artificial Sequence
  synthetic antimicrobial peptide alpha-5
KLKKLLKKLKKLLK

SEQ ID NO: 1872 - protein, 14 aa, Artificial Sequence
  synthetic antimicrobial peptide alpha-6
  AMIDATION (14)...(14): phenylalaninamide
LKLLKKLLKLLKKF

SEQ ID NO: 1873 - protein, 14 aa, Artificial Sequence
  synthetic antimicrobial peptide alpha-7
  AMIDATION (14)...(14): phenylalaninamide
LQLLKQLLKLLKQF

SEQ ID NO: 1874 - protein, 14 aa, Artificial Sequence
  synthetic antimicrobial peptide alpha-8
  AMIDATION (14)...(14): phenylalaninamide
AQAAKQAAKAAKQF

SEQ ID NO: 1875 - protein, 14 aa, Artificial Sequence
  synthetic antimicrobial peptide alpha-9
  AMIDATION (14)...(14): histidinamide
RWRRWWRHFHHFFH

SEQ ID NO: 1876 - protein, 14 aa, Artificial Sequence
  synthetic antimicrobial peptide alpha-10
KLKKLLKRWRRWWR

SEQ ID NO: 1877 - protein, 14 aa, Artificial Sequence
  synthetic antimicrobial peptide alpha-11
  AMIDATION (14)...(14): histidinamide
RWRRLLKKLHHLLH

SEQ ID NO: 1878 - protein, 14 aa, Artificial Sequence
  synthetic antimicrobial peptide alpha-12
  AMIDATION (14)...(14): histidinamide
KLKKLLKHLHHLLH

SEQ ID NO: 1879 - protein, 15 aa, Artificial Sequence
  synthetic antimicrobial peptide BD-1
FVFRHKWVWKHRFLF

SEQ ID NO: 1880 - protein, 15 aa, Artificial Sequence
  synthetic antimicrobial peptide BD-2
VFIHRHVWVHKHVLF

SEQ ID NO: 1881 - protein, 15 aa, Artificial Sequence
  synthetic antimicrobial peptide BD-3
WRWRARWRWRLRWRF

SEQ ID NO: 1882 - protein, 15 aa, Artificial Sequence
  synthetic antimicrobial peptide BD-4
WRIHLRARLHVKFRF

SEQ ID NO: 1883 - protein, 15 aa, Artificial Sequence
  synthetic antimicrobial peptide BD-5
LRIHARFKVHIRLKF

SEQ ID NO: 1884 - protein, 15 aa, Artificial Sequence
  synthetic antimicrobial peptide BD-6
FHIKFRVHLKVRFHF

SEQ ID NO: 1885 - protein, 15 aa, Artificial Sequence
  synthetic antimicrobial peptide BD-7
FHVKIHFRLHVKFHF

SEQ ID NO: 1886 - protein, 15 aa, Artificial Sequence
  synthetic antimicrobial peptide BD-8
LHIHAHFHVHIHLHF

SEQ ID NO: 1887 - protein, 15 aa, Artificial Sequence
  synthetic antimicrobial peptide BD-9
FKIHFRLKVHIRFKF

SEQ ID NO: 1888 - protein, 15 aa, Artificial Sequence
  synthetic antimicrobial peptide BD-10
FKAHIRFKLRVKFHF

SEQ ID NO: 1889 - protein, 15 aa, Artificial Sequence
  synthetic antimicrobial peptide BD-11
LKAKIKFKVKLKIKF

SEQ ID NO: 1890 - protein, 14 aa, Artificial Sequence
  synthetic antimicrobial peptide BD-12
WIWKHKFLHRHFLF

SEQ ID NO: 1891 - protein, 14 aa, Artificial Sequence
  synthetic antimicrobial peptide BD-13
VFLHRHVIKHKLVF

SEQ ID NO: 1892 - protein, 13 aa, Artificial Sequence
  synthetic antimicrobial peptide BD-14
FLHKHVLRHRIVF

SEQ ID NO: 1893 - protein, 13 aa, Artificial Sequence
  synthetic antimicrobial peptide BD-15
VFKHKIVHRHILF

SEQ ID NO: 1894 - protein, 13 aa, Artificial Sequence
  synthetic antimicrobial peptide BD-16
FLFKHLFLHRIFF

SEQ ID NO: 1895 - protein, 12 aa, Artificial Sequence
  synthetic antimicrobial peptide BD-17
LFKHILIHRVIF

SEQ ID NO: 1896 - protein, 12 aa, Artificial Sequence
  synthetic antimicrobial peptide BD-18
FLHKHLFKHKLF

SEQ ID NO: 1897 - protein, 12 aa, Artificial Sequence
  synthetic antimicrobial peptide BD-19
VFRHRFIHRHVF

SEQ ID NO: 1898 - protein, 12 aa, Artificial Sequence
  synthetic antimicrobial peptide BD-20
FIHKLVHKHVLF

SEQ ID NO: 1899 - protein, 12 aa, Artificial Sequence
  synthetic antimicrobial peptide BD-21
VLRHLFRHRIVF

SEQ ID NO: 1900 - protein, 12 aa, Artificial Sequence
  synthetic antimicrobial peptide BD-22
LVHKLILRHLLF

SEQ ID NO: 1901 - protein, 12 aa, Artificial Sequence
  synthetic antimicrobial peptide BD-23
VFKRVLIHKLIF

SEQ ID NO: 1902 - protein, 12 aa, Artificial Sequence
  synthetic antimicrobial peptide BD-24
IVRKFLFRHKVF

SEQ ID NO: 1903 - protein, 12 aa, Artificial Sequence
  synthetic antimicrobial peptide BD-25
VLKHVIAHKRLF

SEQ ID NO: 1904 - protein, 11 aa, Artificial Sequence
  synthetic antimicrobial peptide BD-26
FIRKFLFKHLF

SEQ ID NO: 1905 - protein, 11 aa, Artificial Sequence
  synthetic antimicrobial peptide BD-27
VIRHVWVRKLF

SEQ ID NO: 1906 - protein, 13 aa, Artificial Sequence
  synthetic antimicrobial peptide BD-28
FLFRHRFRHRLVF

SEQ ID NO: 1907 - protein, 13 aa, Artificial Sequence
  synthetic antimicrobial peptide BD-29
LFLHKHAKHKFLF

SEQ ID NO: 1908 - protein, 11 aa, Artificial Sequence
  synthetic antimicrobial peptide BD-30
FKHKFKHKFIF

SEQ ID NO: 1909 - protein, 11 aa, Artificial Sequence
  synthetic antimicrobial peptide BD-31
LRHRLRHRLIF

SEQ ID NO: 1910 - protein, 11 aa, Artificial Sequence
  synthetic antimicrobial peptide BD-32
LILKFLFKFVF

SEQ ID NO: 1911 - protein, 11 aa, Artificial Sequence
  synthetic antimicrobial peptide BD-33
VLIRILVRVIF

SEQ ID NO: 1912 - protein, 9 aa, Artificial Sequence
  synthetic antimicrobial peptide BD-34
FRHRFRHRF

SEQ ID NO: 1913 - protein, 9 aa, Artificial Sequence
  synthetic antimicrobial peptide BD-35
LKHKLKHKF

SEQ ID NO: 1914 - protein, 9 aa, Artificial Sequence
  synthetic antimicrobial peptide BD-36
FKFKHKLIF

SEQ ID NO: 1915 - protein, 9 aa, Artificial Sequence
  synthetic antimicrobial peptide BD-37
LRLRHRVLF

SEQ ID NO: 1916 - protein, 9 aa, Artificial Sequence
  synthetic antimicrobial peptide BD-38
FKFLFKFLF

SEQ ID NO: 1917 - protein, 9 aa, Artificial Sequence
  synthetic antimicrobial peptide BD-39
LRLFLRWLF

SEQ ID NO: 1918 - protein, 9 aa, Artificial Sequence
  synthetic antimicrobial peptide BD-40
FKFLFKHKF

SEQ ID NO: 1919 - protein, 9 aa, Artificial Sequence
  synthetic antimicrobial peptide BD-41
LRLFLRHRF

SEQ ID NO: 1920 - protein, 7 aa, Artificial Sequence
  synthetic antimicrobial peptide BD-42
FKFLFKF

SEQ ID NO: 1921 - protein, 7 aa, Artificial Sequence
  synthetic antimicrobial peptide BD-43
LRLFLRF

SEQ ID NO: 1922 - protein, 14 aa, Artificial Sequence
  synthetic antimicrobial peptide AA-1
  AMIDATION (14)...(14): phenylalaninamide
HHFFHHFHHFFHHF

SEQ ID NO: 1923 - protein, 14 aa, Artificial Sequence
  synthetic antimicrobial peptide AA-2
  AMIDATION (14)...(14): phenylalaninamide
FHFFHHFFHFFHHF

SEQ ID NO: 1924 - protein, 21 aa, Artificial Sequence
  synthetic antimicrobial peptide AA-3
KLLKGATFHFFHHFFHFFHHF

SEQ ID NO: 1925 - protein, 18 aa, Artificial Sequence
  synthetic antimicrobial peptide AA-4
KLLKFHFFHHFFHFFHHF

SEQ ID NO: 1926 - protein, 18 aa, Artificial Sequence
  synthetic antimicrobial peptide AA-5
FHFFHHFFHFFHHFKLLK

SEQ ID NO: 1927 - protein, 7 aa, Staphylococcus sp.
  AMIDATION (7)...(7): phenylalaninamide
YSPWTNF

SEQ ID NO: 1928 - protein, 8 aa, Artificial Sequence
  synthetic DYKDDDDK epitope tag
DYKDDDDK

SEQ ID NO: 1929 - protein, 4 aa, Artificial Sequence
  synthetic His-4 epitope tag
HHHH

SEQ ID NO: 1930 - protein, 5 aa, Artificial Sequence
  synthetic His-5 epitope tag
HHHHH

SEQ ID NO: 1931 - protein, 6 aa, Artificial Sequence
  synthetic His-6 epitope tag
HHHHHH

SEQ ID NO: 1932 - protein, 5 aa, Artificial Sequence
  synthetic peptide linker/spacer
PSGSP

SEQ ID NO: 1933 - protein, 5 aa, Artificial Sequence
  synthetic peptide linker/spacer
ASASA

SEQ ID NO: 1934 - protein, 3 aa, Artificial Sequence
  synthetic peptide linker/spacer
GGG

SEQ ID NO: 1935 - protein, 15 aa, Artificial Sequence
  synthetic longer peptide linker
GGGGSGGGGSGGGGS

SEQ ID NO: 1936 - protein, 3 aa, Artificial Sequence
  synthetic peptide linker
AAA

SEQ ID NO: 1937 - protein, 3 aa, Artificial Sequence
  synthetic peptide linker
GGG

SEQ ID NO: 1938 - protein, 3 aa, Artificial Sequence
  synthetic peptide linker
SGG

SEQ ID NO: 1939 - protein, 6 aa, Artificial Sequence
  synthetic peptide linker
GGSGGS

SEQ ID NO: 1940 - protein, 3 aa, Artificial Sequence
  synthetic peptide linker
SAT

SEQ ID NO: 1941 - protein, 3 aa, Artificial Sequence
  synthetic peptide linker
PYP

SEQ ID NO: 1942 - protein, 5 aa, Artificial Sequence
  synthetic peptide linker
PSPSP

SEQ ID NO: 1943 - protein, 3 aa, Artificial Sequence
  synthetic peptide linker
ASA

SEQ ID NO: 1944 - protein, 5 aa, Artificial Sequence
  synthetic peptide linker
ASASA

SEQ ID NO: 1945 - protein, 5 aa, Artificial Sequence
  synthetic peptide linker
PSPSP

SEQ ID NO: 1946 - protein, 4 aa, Artificial Sequence
  synthetic peptide linker
KKKK

SEQ ID NO: 1947 - protein, 4 aa, Artificial Sequence
  synthetic peptide linker
RRRR

SEQ ID NO: 1948 - protein, 15 aa, Artificial Sequence
  synthetic peptide linker
GGGGSGGGGSGGGGS

SEQ ID NO: 1949 - protein, 11 aa, Artificial Sequence
  synthetic antimicrobial peptide BD2.20
  AMIDATION (11)...(11): leucinamide
FIRKFLKKWLL

SEQ ID NO: 1950 - protein, 11 aa, Artificial Sequence
  synthetic Streptococcus mutans targeting peptide M8 plus tri-Gly linker region
TFFRFLNRGGG

SEQ ID NO: 1951 - protein, 24 aa, Artificial Sequence
  synthetic Fmoc-M8-GGG-K(Mtt)-(CH-2)-7CO-BD2.20
  MOD_RES (1)...(1): 9-fluorenylmethoxycarbonyl-threonine (Fmoc-Thr)
  MOD_RES (12)...(12): epsilon amino-4-methyltrityl-lysine (Lys(Mtt))
  MOD_RES (13)...(13): Xaa = 8-aminocaprylic acid, 8-aminooctanoic acid, omega-aminocaprylic acid, -[NH(CH-2)-7CO]-
  AMIDATION (24)...(24): leucinamide
TFFRFLNRGGGKXFIRKFLKKWLL

SEQ ID NO: 1952 - protein, 15 aa, Artificial Sequence
  synthetic Pseudomonas-targeting side-chain peptide KH
KKHRKHRKHRKHGGG

SEQ ID NO: 1953 - protein, 29 aa, Artificial Sequence
  synthetic specifically targeted anti-microbial peptide (STAMP) 1845L6-21
  AMIDATION (29)...(29): leucinamide
KFINGVLSQFVLERKPYPKLFKFLRKHLL

SEQ ID NO: 1954 - protein, 4 aa, Artificial Sequence
  synthetic peptide linker
GGGG

SEQ ID NO: 1955 - protein, 5 aa, Artificial Sequence
  synthetic peptide linker
GGGGS

SEQ ID NO: 1956 - protein, 10 aa, Artificial Sequence
  synthetic peptide linker
GGGGSGGGGS

SEQ ID NO: 1957 - protein, 20 aa, Artificial Sequence
  synthetic peptide linker
GGGGSGGGGSGGGGSGGGGS

SEQ ID NO: 1958 - protein, 25 aa, Artificial Sequence
  synthetic peptide linker
GGGGSGGGGSGGGGSGGGGSGGGGS

SEQ ID NO: 1959 - protein, 30 aa, Artificial Sequence
  synthetic peptide linker
GGGGSGGGGSGGGGSGGGGSGGGGSGGGGS

SEQ ID NO: 1960-1968 - skipped (9 entries)

SEQ ID NO: 1969 - protein, 19 aa, Artificial Sequence
  synthetic specifically targeted anti-microbial peptide (STAMP) 135(L7)2_1
  AMIDATION (19)...(19): phenylalaninamide
FHFHLHFPYPFIKHFIHRF

SEQ ID NO: 1970 - protein, 19 aa, Artificial Sequence
  synthetic specifically targeted anti-microbial peptide (STAMP) 135(L3)2_1
  AMIDATION (19)...(19): phenylalaninamide
FHFHLHFSATFIKHFIHRF

SEQ ID NO: 1971 - protein, 19 aa, Artificial Sequence
  synthetic specifically targeted anti-microbial peptide (STAMP) 135(L1)2_1
  AMIDATION (19)...(19): phenylalaninamide
FHFHLHFGGGFIKHFIHRF

SEQ ID NO: 1972 - protein, 21 aa, Artificial Sequence
  synthetic specifically targeted anti-microbial peptide (STAMP) 135(L8)2_1
  AMIDATION (21)...(21): phenylalaninamide
FHFHLHFPSGSPFIKHFIHRF

SEQ ID NO: 1973 - protein, 21 aa, Artificial Sequence
  synthetic specifically targeted anti-microbial peptide (STAMP) 135(L9)2_1
  AMIDATION (21)...(21): phenylalaninamide
FHFHLHFPSPSPFIKHFIHRF

SEQ ID NO: 1974 - protein, 21 aa, Artificial Sequence
  synthetic specifically targeted anti-microbial peptide (STAMP) 135(L5)2_1
  AMIDATION (21)...(21): phenylalaninamide
FHFHLHFASASAFIKHFIHRF

SEQ ID NO: 1975 - protein, 19 aa, Artificial Sequence
  synthetic specifically targeted anti-microbial peptide (STAMP) 3_1(L1)135
  AMIDATION (19)...(19): phenylalaninamide
LIKHILHRLGGGFHFHLHF

SEQ ID NO: 1976 - protein, 7 aa, Artificial Sequence
  synthetic killing peptide PL-135
  AMIDATION (7)...(0): phenylalaninamide
FHFHLHF

SEQ ID NO: 1977 - protein, 19 aa, Artificial Sequence
  synthetic specifically targeted anti-microbial peptide (STAMP) 2_1(L1)2C-4
  AMIDATION (19)...(19): phenylalaninamide
FIKHFIHRFGGGRWRWRWF

SEQ ID NO: 1978 - protein, 19 aa, Artificial Sequence
  synthetic specifically targeted anti-microbial peptide (STAMP) 2_1(L6)2C-4
  AMIDATION (19)...(19): phenylalaninamide
FIKHFIHRFSGGRWRWRWF

SEQ ID NO: 1979 - protein, 19 aa, Artificial Sequence
  synthetic specifically targeted anti-microbial peptide (STAMP) 2_1(L3)2C-4
  AMIDATION (19)...(19): phenylalaninamide
FIKHFIHRFSATRWRWRWF

SEQ ID NO: 1980 - protein, 17 aa, Artificial Sequence
  synthetic specifically targeted anti-microbial peptide (STAMP) 2_1(LC)2C-4
  MOD_RES (10)...(10): Xaa = 8-aminocaprylic acid, 8-aminooctanoic acid, omega-aminocaprylic acid, -[NH(CH-2)-7CO]-
  AMIDATION (17)...(17): phenylalaninamide
FIKHFIHRFXRWRWRWF

SEQ ID NO: 1981 - skipped

SEQ ID NO: 1982 - protein, 19 aa, Artificial Sequence
  synthetic specifically targeted anti-microbial peptide (STAMP) 2C-4(L1)2_1
  AMIDATION (19)...(19): phenylalaninamide
RWRWRWFGGGFIKHFIHRF

SEQ ID NO: 1983 - protein, 19 aa, Artificial Sequence
  synthetic specifically targeted anti-microbial peptide (STAMP) 2C-4(L6)2_1
  AMIDATION (19)...(19): phenylalaninamide
RWRWRWFSGGFIKHFIHRF

SEQ ID NO: 1984 - protein, 19 aa, Artificial Sequence
  synthetic specifically targeted anti-microbial peptide (STAMP) 2C-4(L3)2_1
  AMIDATION (19)...(19): phenylalaninamide
RWRWRWFSATFIKHFIHRF

SEQ ID NO: 1985 - protein, 17 aa, Artificial Sequence
  synthetic specifically targeted anti-microbial peptide (STAMP) 2C-4(LC)2_1
  MOD_RES (8)...(8): Xaa = 8-aminocaprylic acid, 8-aminooctanoic acid, omega-aminocaprylic acid, -[NH(CH-2)-7CO]-
  AMIDATION (17)...(17): phenylalaninamide
RWRWRWFXFIKHFIHRF

SEQ ID NO: 1986 - skipped

SEQ ID NO: 1987 - protein, 24 aa, Artificial Sequence
  synthetic specifically targeted anti-microbial peptide (STAMP) 2_1(LC)alpha-11
  MOD_RES (10)...(10): Xaa = 8-aminocaprylic acid, 8-aminooctanoic acid, omega-aminocaprylic acid, -[NH(CH-2)-7CO]-
  AMIDATION (24)...(24): histidinamide
FIKHFIHRFXRWRRLLKKLHHLLH

SEQ ID NO: 1988 - skipped

SEQ ID NO: 1989 - protein, 26 aa, Artificial Sequence
  synthetic peptide linker
  AMIDATION (26)...(26): histidinamide
FIKHFIHRFSATRWRRLLKKLHHLLH

SEQ ID NO: 1990 - protein, 26 aa, Artificial Sequence
  synthetic peptide linker
  AMIDATION (26)...(26): histidinamide
FIKHFIHRFSGGRWRRLLKKLHHLLH

SEQ ID NO: 1991 - protein, 24 aa, Artificial Sequence
  synthetic specifically targeted anti-microbial peptide (STAMP) alpha-11(LC)2_1
  MOD_RES (15)...(15): Xaa = 8-aminocaprylic acid, 8-aminooctanoic acid, omega-aminocaprylic acid, -[NH(CH-2)-7CO]-
  AMIDATION (24)...(24): phenylalaninamide
RWRRLLKKLHHLLHXFIKHFIHRF

SEQ ID NO: 1992 - skipped

SEQ ID NO: 1993 - protein, 26 aa, Artificial Sequence
  synthetic peptide linker
  AMIDATION (26)...(26): phenylalaninamide
RWRRLLKKLHHLLHSATFIKHFIHRF

SEQ ID NO: 1994 - protein, 26 aa, Artificial Sequence
  synthetic peptide linker
  AMIDATION (26)...(26): phenylalaninamide
RWRRLLKKLHHLLHSGGFIKHFIHRF

SEQ ID NO: 1995 - protein, 24 aa, Artificial Sequence
  synthetic specifically targeted anti-microbial peptide (STAMP) 2_1(LC)alpha-7
  MOD_RES (10)...(10): Xaa = 8-aminocaprylic acid, 8-aminooctanoic acid, omega-aminocaprylic acid, -[NH(CH-2)-7CO]-
  AMIDATION (24)...(24): phenylalaninamide
FIKHFIHRFXLQLLKQLLKLLKQF

SEQ ID NO: 1996 - skipped

SEQ ID NO: 1997 - protein, 26 aa, Artificial Sequence
  synthetic specifically targeted anti-microbial peptide (STAMP) 2_1(L3)alpha-7
  AMIDATION (26)...(26): phenylalaninamide
FIKHFIHRFSATLQLLKQLLKLLKQF

SEQ ID NO: 1998 - protein, 26 aa, Artificial Sequence
  synthetic specifically targeted anti-microbial peptide (STAMP) alpha-7(LC)2_1
  AMIDATION (26)...(26): phenylalaninamide
FIKHFIHRFSGGLQLLKQLLKLLKQF

SEQ ID NO: 1999 - protein, 24 aa, Artificial Sequence
  synthetic
  MOD_RES (15)...(15): Xaa = 8-aminocaprylic acid, 8-aminooctanoic acid, omega-aminocaprylic acid, -[NH(CH-2)-7CO]-
  AMIDATION (24)...(24): phenylalaninamide
LQLLKQLLKLLKQFXFIKHFIHRF

SEQ ID NO: 2000 - skipped

SEQ ID NO: 2001 - protein, 26 aa, Artificial Sequence
  synthetic specifically targeted anti-microbial peptide (STAMP) alpha-7(L3)2_1
  AMIDATION (26)...(26): phenylalaninamide
LQLLKQLLKLLKQFSATFIKHFIHRF

SEQ ID NO: 2002 - protein, 26 aa, Artificial Sequence
  synthetic specifically targeted anti-microbial peptide (STAMP) alpha-7(L6)2_1
  AMIDATION (26)...(26): phenylalaninamide
LQLLKQLLKLLKQFSGGFIKHFIHRF

SEQ ID NO: 2003 - protein, 23 aa, Artificial Sequence
  synthetic specifically targeted anti-microbial peptide (STAMP) B38(L1)2_1
  AMIDATION (23)...(23): phenylalaninamide
IKQLLHFFQRFGGGFIKHFIHRF

SEQ ID NO: 2004 - protein, 23 aa, Artificial Sequence
  synthetic specifically targeted anti-microbial peptide (STAMP) 2_1(L1)B38
  AMIDATION (23)...(23): phenylalaninamide
FIKHFIHRFGGGIKQLLHFFQRF

SEQ ID NO: 2005 - protein, 23 aa, Artificial Sequence
  synthetic specifically targeted anti-microbial peptide (STAMP) 2_1(L1)B33
  AMIDATION (23)...(23): phenylalaninamide
FIKHFIHRFGGGFKKFWKWFRRF

SEQ ID NO: 2006 - protein, 23 aa, Artificial Sequence
  synthetic specifically targeted anti-microbial peptide (STAMP) B33(L1)2_1
  AMIDATION (23)...(23): phenylalaninamide
FKKFWKWFRRFGGGFIKHFIHRF

SEQ ID NO: 2007 - protein, 9 aa, Artificial Sequence
  synthetic BL-1 peptide with no bacterial binding
DAANEAGGG

SEQ ID NO: 2008 - protein, 12 aa, Artificial Sequence
  synthetic B43-GGG peptide
FIDSFIRSFGGG

SEQ ID NO: 2009 - protein, 9 aa, Artificial Sequence
  synthetic Streptococcus mutans-specific binding peptide 2_4 (S3L1-10)
FIKDFIERF

SEQ ID NO: 2010 - protein, 9 aa, Artificial Sequence
  synthetic Streptococcus mutans-specific targeting peptide 1_5 (S3L1-5)
WWYNWWQDW

SEQ ID NO: 2011 - protein, 9 aa, Artificial Sequence
  synthetic Streptococcus mutans-specific targeting peptide 1_2
WWHSWWSTW

SEQ ID NO: 2012 - protein, 9 aa, Artificial Sequence
  synthetic Streptococcus mutans-specific targeting peptide 1_3
WWSYWWTQW

SEQ ID NO: 2013 - protein, 9 aa, Artificial Sequence
  synthetic Streptococcus mutans-specific targeting peptide 1_4
WWKDWWERW

SEQ ID NO: 2014 - protein, 9 aa, Artificial Sequence
  synthetic Streptococcus mutans-specific targeting peptide 1_6
WWQDWWNEW

SEQ ID NO: 2015 - protein, 9 aa, Artificial Sequence
  synthetic Streptococcus mutans-specific targeting peptide 2_1
FIKHFIHRF

SEQ ID NO: 2016 - protein, 9 aa, Artificial Sequence
  synthetic Streptococcus mutans-specific targeting peptide 3_1
LIKHILHRL

SEQ ID NO: 2017 - protein, 20 aa, Artificial Sequence
  synthetic specifically targeted anti-microbial peptide (STAMP) 135(G-4)2_1
  AMIDATION (20)...(20): phenylalaninamide
FHFHLHFGGGGFIKHFIHRF

SEQ ID NO: 2018 - protein, 21 aa, Artificial Sequence
  synthetic specifically targeted anti-microbial peptide (STAMP) 135(G-5)2_1
  AMIDATION (21)...(21): phenylalaninamide
FHFHLHFGGGGGFIKHFIHRF

SEQ ID NO: 2019 - protein, 22 aa, Artificial Sequence
  synthetic specifically targeted anti-microbial peptide (STAMP) 135(G-6)2_1
  AMIDATION (22)...(22): phenylalaninamide
FHFHLHFGGGGGGFIKHFIHRF

SEQ ID NO: 2020 - protein, 23 aa, Artificial Sequence
  synthetic specifically targeted anti-microbial peptide (STAMP) 135(G-7)2_1
  AMIDATION (23)...(23): phenylalaninamide
FHFHLHFGGGGGGGFIKHFIHRF

SEQ ID NO: 2021 - protein, 19 aa, Artificial Sequence
  synthetic specifically targeted anti-microbial peptide (STAMP) 135(L11)2_1
  AMIDATION (19)...(19): phenylalaninamide
FHFHLHFSGSFIKHFIHRF

SEQ ID NO: 2022 - protein, 21 aa, Artificial Sequence
  synthetic specifically targeted anti-microbial peptide (STAMP) 135(L12)2_1
  AMIDATION (21)...(21): phenylalaninamide
FHFHLHFGSGSGFIKHFIHRF

SEQ ID NO: 2023 - protein, 19 aa, Artificial Sequence
  synthetic specifically targeted anti-microbial peptide (STAMP) Ac135(L1)2_1
  ACETYLATION (1)...(1): acetyl-phenylalanine
  AMIDATION (19)...(19): phenylalaninamide
FHFHLHFGGGFIKHFIHRF

SEQ ID NO: 2024 - protein, 19 aa, Artificial Sequence
  synthetic specifically targeted anti-microbial peptide (STAMP) bz135(L1)2_1
  MOD_RES (1)...(1): phenylalanine benzoate
  AMIDATION (19)...(19): phenylalaninamide
FHFHLHFGGGFIKHFIHRF

SEQ ID NO: 2025 - protein, 19 aa, Artificial Sequence
  synthetic specifically targeted anti-microbial peptide (STAMP) 135(L2)2_1
  AMIDATION (19)...(19): phenylalaninamide
FHFHLHFAAAFIKHFIHRF

SEQ ID NO: 2026 - protein, 19 aa, Artificial Sequence
  synthetic specifically targeted anti-microbial peptide (STAMP) 135(L13)2_1
  AMIDATION (19)...(19): phenylalaninamide
FHFHLHFAGAFIKHFIHRF

SEQ ID NO: 2027 - protein, 21 aa, Artificial Sequence
  synthetic specifically targeted anti-microbial peptide (STAMP) 135(L14)2_1
  AMIDATION (21)...(21): phenylalaninamide
FHFHLHFGAGAGFIKHFIHRF

SEQ ID NO: 2028 - protein, 19 aa, Artificial Sequence
  synthetic specifically targeted anti-microbial peptide (STAMP) 2_1i(L1)135i
  AMIDATION (19)...(19): phenylalaninamide
FRHIFHKIFGGGFHLHFHF

SEQ ID NO: 2029 - protein, 19 aa, Artificial Sequence
  synthetic specifically targeted anti-microbial peptide (STAMP) 135i(L1)2_1i
  AMIDATION (19)...(19): phenylalaninamide
FHLHFHFGGGFRHIFHKIF

SEQ ID NO: 2030 - protein, 17 aa, Artificial Sequence
  synthetic specifically targeted anti-microbial peptide (STAMP) 135(LC)2_1
  MOD_RES (8)...(8): Xaa = 8-aminocaprylic acid, 8-aminooctanoic acid, omega-aminocaprylic acid, -[NH(CH-2)-7CO]-
  AMIDATION (17)...(17): phenylalanine
FHFHLHFXFIKHFIHRF

What is claimed is:

1. A chimeric moiety, said moiety comprising: an effector attached to a peptide targeting moiety comprising the amino acid sequence:

MKMRAGQVVFIYKLILVLLFYV LQKLFDLKKGCF. (SEQ ID NO: 26)

2. The chimeric moiety of claim 1, wherein said targeting moiety is a peptide consisting of the amino acid sequence:

MKMRAGQVVFIYKLILVLLFYVLQKLFDLKK GCF. (SEQ ID NO: 26)

3. The chimeric moiety of claim 1, wherein said effector comprises a moiety selected from the group consisting of a detectable label, an antimicrobial peptide, an antibiotic, and a photosensitizer.

4. The chimeric moiety of claim 1, wherein said effector comprises an antimicrobial peptide.

5. The chimeric moiety of claim 1, wherein said effector comprises an antibiotic.

6. The chimeric moiety of claim 1, wherein said effector comprises a photosensitizing agent.

7. The chimeric moiety of claim 6, wherein said effector comprises a photosensitizing agent selected from the group consisting of a porphyrinic macrocycle, a porphyrin, a chlorine, a crown ether, an acridine, an azine, a phthalocyanine, a cyanine, a psoralen, and a perylenequinonoid.

8. The chimeric moiety of claim 4, wherein said effector comprises an antimicrobial peptide wherein said antimicrobial peptide comprises the amino acid sequence:

KNLRIIRKGIHIIKKY. (SEQ ID NO: 1820)

9. The chimeric moiety of claim 8, wherein said antimicrobial peptide consists of the amino acid sequence:

KNLRIIRKGIHIIKKY. (SEQ ID NO: 1820)

10. The chimeric moiety according to any one of claims 1-7, 8, and 9, wherein said targeting moiety is chemically conjugated to said effector.

11. The chimeric moiety of claim 10, wherein said targeting moiety is chemically conjugated to said effector via a linker.

12. The chimeric moiety of claim 10, wherein said targeting moiety is chemically conjugated to said effector via a linker comprising a polyethylene glycol (PEG).

13. The chimeric moiety of claim 10, wherein said targeting moiety is chemically conjugated to said effector via a non-peptide linker.

14. The chimeric moiety according to any one of claims 1-7, 8, and 9, wherein said targeting moiety is linked directly to said effector.

15. The chimeric moiety according to any one of claims 1-7, 8, and 9, wherein said targeting moiety is linked to said effector via a peptide linker.

16. The chimeric moiety according to any one of claims 4, 8, and 9, wherein the chimeric moiety is a fusion protein.

17. The chimeric moiety of claim 16, wherein said targeting moiety is attached to said effector via a peptide linker comprising an amino acid sequence selected from the group consisting of AAA (SEQ ID NO:NO:1936), GGG (SEQ ID NO:1937), SGG (SEQ ID NO:1938), GGSGGS (SEQ ID NO:1939), SAT (SEQ ID NO:1940), pyp (SEQ ID NO:1941), PSPSP (SEQ ID NO:1942), ASA (SEQ ID NO:1943), ASASA (SEQ ID NO:1944), PSPSP (SEQ ID NO:1945), KKKIZ (SEQ ID NO:1946), RRRR (SEQ ID NO:1947), GGGGSGGGGSGGGGS (SEQ ID NO:1948), GGGG (SEQ ID NO:1954), GGGGS (SEQ ID NO:1955), GGGGSGGGGS (SEQ ID NO:1956), GGGGSGGGGSGGGGSGGGGS (SEQ ID NO:1957), GGGGSGGGGSG GGGSGGGGSGGGGS (SEQ ID NO:1958), and GGGGSGGGGSGGGGSGGGGSGGGGSG GGGS (SEQ ID NO:1959).

18. The chimeric moiety of claim 15, wherein said chimeric moiety is functionalized with a polymer to increase serum halflife.

19. The chimeric moiety of claim 16, wherein said polymer comprises polyethylene glycol and/or a cellulose or modified cellulose.

20. A pharmaceutical composition comprising a chimeric moiety according to any one of claims 1-7, 8, and 9 in a pharmaceutically acceptable carrier.

21. The composition of claim 20, wherein said composition is formulated as a unit dosage formulation.

22. The composition of claim 20, wherein said composition is formulated for administration by a modality selected from the group consisting of intraperitoneal administration, topical administration, oral administration, inhalation administration, transdermal administration, subdermal depot administration, and rectal administration.

23. The chimeric moiety of claim 5, wherein said effector comprises an antibiotic is selected from the group consisting of Amikacin, Gentamicin, Kanamycin, Neomycin, Netilmicin, Streptomycin, Tobramycin, Paromomycin, Loracarbef, Ertapenem, Doripenem, Imipenem, Cilastatin, Meropenem, Cefadroxil, Cefazolin, Cefalotin, Cefalothin, Cefalexin, Cefaclor, Cefamandole, Cefoxitin, Cefprozil, Cefuroxime, Cefixime, Cefdinir, Cefditoren, Cefoperazone, Cefotaxime, Cefpodoxime, Ceftazidime, Ceftibuten, Ceftizoxime, Ceftriaxone, Cefepime, Ceftobiprole, Teicoplanin, Vancomycin, Macrolides, Zithromax, Biaxin, Dirithromycin, Erythocin, Erythroped, Roxithromycin, Troleandomycin, Ketek, Aztreonam, Amoxicillin, Ampicillin, Azlocillin, Carbenicillin, Cloxacillin, Dicloxacillin, Flucloxacillin, Mezlocillin, Meticillin, Nafcillin, Oxacillin, Penicillin, Piperacillin, Ticarcillin, Bacitracin, Colistin, Polymyxin B, Mafenide, Prontosil, Sulfacetamide, Sulfamethizole, Sulfanilimide, Sulfasalazine, Sulfisoxazole, Trimethoprim Trimethoprim-Sulfamethoxazole (Co-trimoxazole) (TMP-SMX), Demeclocycline, Doxycycline, Minocycline, Oxytetracycline, Tetracycline, squalamine, CSA-8, CSA-11, CSA-13, CSA-15, CSA-25, CSA-46, CSA-54, CSA-90, CSA-97, Arsphenamine, Chloramphenicol, Clindamycin, Lincomycin, Ethambutol, Fosfomycin, Fusidic acid, Furazolidone, Isoniazid, Linezolid, Metronidazole, Mupirocin, Nitrofurantoin, Platensimycin, Pyrazinamide, Quinupristin, Dalfopristin, Rifampin, Rifampicin, and Timidazole.

24. The chimeric moiety of claim 16, wherein said targeting moiety is attached to said effector via a peptide linker the amino acid sequence of which consists of the sequence GGG (SEQ ID NO: 1937).

25. The chimeric moiety of claim 7, wherein said photosensitizing agent is a porphyrin.

26. The chimeric moiety of claim 7, wherein said photosensitizing agent is a phthalocyanine.

27. The chimeric moiety of claim 7, wherein said photosensitizing agent is a compound according to the formula:

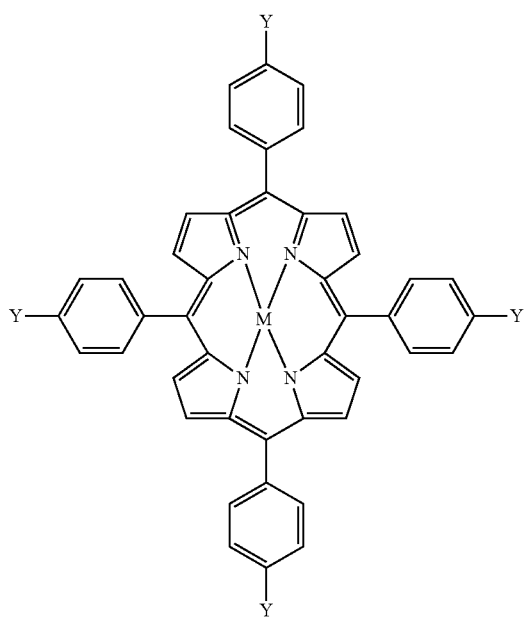

wherein the substitutions at positions M, and Y are selected from the group consisting of:
M is 2H and Y is $SO_3H$; and
M is 2H and Y is $N(CH_3)_3^+$.

28. The chimeric moiety of claim 7, wherein said photosensitizing agent is a compound according to the formula:

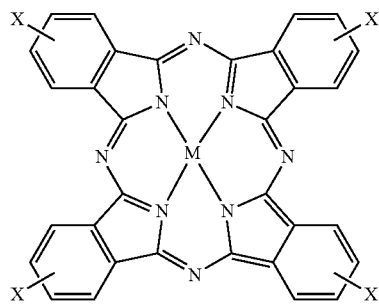

wherein the substitutions at positions M, and X are selected from the group consisting of:
M is $HOSiOSiCH_2CH_2N(CH_3)_2$, and X is H;
M is GaIII, AlIII, or ZnII, and X is $SO_3H$ or $C(CH_3)_2$;
M is 2H and X is $C(CH_3)_2$;
M is Zn and X is

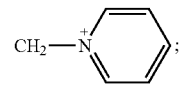

M is Zn and X is $SO_2N(CH_2CH_2OH)_2$;
M is Zn and X is $SO_3H$.

29. The chimeric moiety of claim 7, wherein said photosensitizing agent is a compound selected from the group consisting of Monoastral Fast Blue B, and Monoastral Fast Blue G.

30. The chimeric moiety of claim 7, wherein said photosensitizing agent is an azine photosensitizer.

31. The chimeric moiety of claim 7, wherein said photosensitizing agent is selected from the group consisting of methylene blue, toluidine blue 0, neutral red, proflavine, acridine orange, aminacrine, and ethacridine.

32. The chimeric moiety of claim 7, wherein said photosensitizing agent is a cyanine.

33. The chimeric moiety of claim 7, wherein said photosensitizing agent is selected from the group consisting of psoralen, thienocoumarin, 8-azacoumarin, 2-thiofuranocoumarin, and 2-selenofuranocoumarin.

34. The chimeric moiety of claim 7, wherein said photosensitizing agent is selected from the group consisting of hypocrellin A, hypocrellin B, and calphostin C.

35. The chimeric moiety of claim 7, wherein said photosensitizing agent is an acridine.

36. The chimeric moiety of claim 7, wherein said photosensitizing agent is rose bengal.

37. The composition of claim 7, wherein said photosensitizing agent is a crown ether.

* * * * *